(12) United States Patent
Macina et al.

(10) Patent No.: US 7,678,889 B2
(45) Date of Patent: Mar. 16, 2010

(54) COMPOSITIONS AND METHODS RELATING TO OVARIAN SPECIFIC GENES AND PROTEINS

(75) Inventors: Roberto A. Macina, San Jose, CA (US); Susana Salceda, San Jose, CA (US); Chenghua Liu, San Jose, CA (US); Yongming Sun, Redwood City, CA (US); Leah R. Turner, Sunnyvale, CA (US)

(73) Assignee: diaDexus, Inc., South San Francisco, CA (US)

( * ) Notice: Subject to any disclaimer, the term of this patent is extended or adjusted under 35 U.S.C. 154(b) by 54 days.

(21) Appl. No.: 10/523,834

(22) PCT Filed: Aug. 6, 2003

(86) PCT No.: PCT/US03/24669

§ 371 (c)(1),
(2), (4) Date: Apr. 26, 2006

(87) PCT Pub. No.: WO2004/013311

PCT Pub. Date: Feb. 12, 2004

(65) Prior Publication Data

US 2006/0199180 A1 Sep. 7, 2006

Related U.S. Application Data

(60) Provisional application No. 60/401,469, filed on Aug. 6, 2002.

(51) Int. Cl.
*C07K 16/00* (2006.01)
(52) U.S. Cl. .................................................. 530/387.1
(58) Field of Classification Search ............... 530/387.1
See application file for complete search history.

(56) References Cited

U.S. PATENT DOCUMENTS

| 5,304,496 | A | 4/1994 | Hoyer et al. ............ 436/86 |
| 5,340,934 | A | 8/1994 | Termine et al. ......... 536/23.5 |
| 5,693,762 | A * | 12/1997 | Queen et al. .......... 530/387.3 |
| 6,509,026 | B1 | 1/2003 | Ashkar et al. ........... 424/422 |
| 6,551,795 | B1 | 4/2003 | Rubenfield et al. ...... 435/69.1 |
| 6,551,990 | B2 | 4/2003 | Giachelli et al. ........... 514/2 |
| 6,753,314 | B1 | 6/2004 | Giot et al. ................ 514/12 |
| 6,812,339 | B1 | 11/2004 | Venter et al. ......... 536/24.31 |
| 6,995,018 | B1 | 2/2006 | Fisher et al. ............. 435/7.1 |
| 7,060,275 | B2 | 6/2006 | Mueller et al. ......... 424/178.1 |
| 7,081,516 | B2 | 7/2006 | Markowitz ............. 530/350 |
| 7,091,175 | B2 | 8/2006 | Nokihara et al. ........... 514/2 |
| 7,118,912 | B2 | 10/2006 | Markowitz ............. 435/331 |
| 7,125,663 | B2 | 10/2006 | Schlegel et al. ............ 435/6 |
| 7,125,679 | B2 | 10/2006 | Ashkar ................... 435/7.2 |
| 2002/0048577 | A1 | 4/2002 | Bornstein et al. ...... 424/94.63 |
| 2002/0058336 | A1 | 5/2002 | Ashkar ................... 435/368 |
| 2002/0086384 | A1 | 7/2002 | Levine et al. ............ 435/183 |
| 2003/0065157 | A1 | 4/2003 | Lasek ..................... 536/23.1 |
| 2003/0087250 | A1 | 5/2003 | Monahan et al. ............ 435/6 |
| 2003/0099685 | A1 | 5/2003 | Ashkar et al. ............ 424/426 |
| 2003/0108963 | A1 | 6/2003 | Schlegel et al. ......... 435/7.23 |
| 2003/0118585 | A1 * | 6/2003 | Muller et al. ........... 424/143.1 |
| 2003/0124128 | A1 | 7/2003 | Lillie et al. ............ 424/155.1 |
| 2003/0134283 | A1 | 7/2003 | Peterson et al. ............ 435/6 |
| 2003/0148410 | A1 | 8/2003 | Berger et al. .......... 435/7.23 |
| 2003/0157486 | A1 | 8/2003 | Graff et al. ................ 435/6 |
| 2003/0186325 | A1 | 10/2003 | Barry et al. .............. 435/7.1 |
| 2003/0203372 | A1 | 10/2003 | Ward et al. ................ 435/6 |
| 2003/0233675 | A1 | 12/2003 | Cao et al. ................ 800/279 |
| 2004/0005579 | A1 | 1/2004 | Birse et al. ................ 435/6 |
| 2004/0010116 | A1 | 1/2004 | Ashkar .................... 530/322 |
| 2004/0022797 | A1 | 2/2004 | Winslow et al. ......... 424/185.1 |
| 2004/0029129 | A1 | 2/2004 | Wang et al. ............... 435/6 |
| 2004/0034193 | A1 | 2/2004 | Ashkar .................... 530/350 |
| 2004/0034888 | A1 | 2/2004 | Liu et al. ................ 800/289 |
| 2004/0053348 | A1 | 3/2004 | Faris et al. ............. 435/7.23 |

(Continued)

FOREIGN PATENT DOCUMENTS

| DE | 198 17 557 | 4/1998 |
| DE | 101 27 572 | 12/2002 |
| DE | 103 16 701 | 4/2003 |
| EP | 1 033 405 | 9/2000 |
| EP | 1 439 393 | 7/2004 |

(Continued)

OTHER PUBLICATIONS

Mukoyama et al (Hypertension, Aug. 1988, 12(2): 117-121).*
NCBI Genbank Accession No. AAP36151 [gi:30583805] with Revision History—May 13, 2003.
NCBI Genbank Accession No. NP_000573 [gi:4759166] with Revision History—May 7, 1999-Nov. 5, 2002.

(Continued)

*Primary Examiner*—Sean E Aeder
(74) *Attorney, Agent, or Firm*—Licata & Tyrrell P.C.; Keith R. McCollum

(57) ABSTRACT

The present invention relates to newly identified nucleic acid molecules and polypeptides present in normal and neoplastic ovarian cells, including fragments, variants and derivatives of the nucleic acids and polypeptides. The present invention also relates to antibodies to the polypeptides of the invention, as well as agonists and antagonists of the polypeptides of the invention. The invention also relates to compositions containing the nucleic acid molecules, polypeptides, antibodies, agonists and antagonists of the invention and methods for the use of these compositions. These uses include identifying, diagnosing, monitoring, staging, imaging and treating ovarian cancer and noncancerous disease states in ovarian, identifying ovarian tissue, monitoring and identifying and/or designing agonists and antagonists of polypeptides of the invention. The uses also include gene therapy, production of transgenic animals and cells, and production of engineered ovarian tissue for treatment and research.

12 Claims, No Drawings

U.S. PATENT DOCUMENTS

| | | | |
|---|---|---|---|
| 2004/0072189 A1 | 4/2004 | Smith et al. | 435/6 |
| 2004/0076981 A1 | 4/2004 | Yoder et al. | 435/6 |
| 2004/0110712 A1 | 6/2004 | Markowitz et al. | 514/44 |
| 2004/0123343 A1 | 6/2004 | La Rosa et al. | 800/278 |
| 2004/0142865 A1 | 7/2004 | Weber et al. | 514/12 |
| 2004/0146907 A1 | 7/2004 | Smith | 435/6 |
| 2004/0157253 A1 | 8/2004 | Xu et al. | 435/6 |
| 2004/0157278 A1 | 8/2004 | Astle et al. | 435/7.23 |
| 2004/0172684 A1 | 9/2004 | Kovalic et al. | 800/284 |
| 2004/0214272 A1 | 10/2004 | La Rosa et al. | 435/69.1 |
| 2004/0229277 A1 | 11/2004 | Frantz et al. | 435/6 |
| 2004/0234524 A1 | 11/2004 | Uede et al. | 424/145.1 |
| 2004/0235720 A1 | 11/2004 | Boschert et al. | 514/12 |
| 2005/0014165 A1 | 1/2005 | Lee et al. | 435/6 |
| 2005/0037439 A1 | 2/2005 | Bourner et al. | 435/7.2 |
| 2005/0048614 A1 | 3/2005 | Ashkar | 435/69.1 |
| 2005/0074793 A1 | 4/2005 | Wilson et al. | 435/6 |
| 2005/0142569 A1 | 6/2005 | Guild et al. | 435/6 |
| 2005/0202421 A1 | 9/2005 | Hirsch et al. | 435/6 |
| 2005/0203205 A1 | 9/2005 | McMichael et al. | 530/350 |
| 2005/0226868 A1 | 10/2005 | Ashkenazi et al. | 424/143.1 |
| 2005/0233353 A1 | 10/2005 | Markowitz | 435/6 |
| 2006/0002923 A1 | 1/2006 | Uede et al. | 424/143.1 |
| 2006/0084796 A1 | 4/2006 | Alexandrov et al. | 536/23.1 |
| 2006/0105013 A1 | 5/2006 | Ashkar | 424/423 |
| 2006/0123505 A1 | 6/2006 | Kikuchi et al. | 800/278 |
| 2006/0134668 A1 | 6/2006 | Markowitz | 435/6 |
| 2006/0160090 A1 | 7/2006 | Macina et al. | 435/6 |
| 2006/0199180 A1 | 9/2006 | Macina et al. | 435/6 |
| 2006/0263370 A1 | 11/2006 | Smith et al. | 424/155.1 |
| 2006/0263774 A1 | 11/2006 | Clark et al. | 435/6 |
| 2007/0015145 A1 | 1/2007 | Woolf et al. | 435/6 |
| 2007/0044171 A1 | 2/2007 | Kovalic et al. | 800/278 |
| 2007/0048301 A1 | 3/2007 | Bodary-Winter et al. | 424/143.1 |
| 2007/0060743 A1 | 3/2007 | Tang et al. | 536/23.1 |
| 2007/0061916 A1 | 3/2007 | Kovalic et al. | 800/278 |
| 2007/0072221 A1 | 3/2007 | Ashkar | 435/6 |

FOREIGN PATENT DOCUMENTS

| | | |
|---|---|---|
| EP | 1 498 424 | 1/2005 |
| JP | 2002 531517 | 9/2001 |
| JP | 2003 517284 | 5/2003 |
| JP | 2003 259877 | 9/2003 |
| JP | 2004-532622 | 10/2004 |
| WO | WO 89/07613 | 8/1989 |
| WO | WO 92/22316 | 12/1992 |
| WO | WO 99/07844 | 2/1999 |
| WO | WO 99/08730 | 2/1999 |
| WO | WO 99/15904 | 4/1999 |
| WO | WO 00/33865 | 6/2000 |
| WO | WO 00/62065 | 10/2000 |
| WO | WO 00/63236 | 10/2000 |
| WO | WO 00/63241 | 10/2000 |
| WO | WO 00/63247 * | 10/2000 |
| WO | WO 01/68912 A2 * | 9/2001 |
| WO | WO 01/70979 | 9/2001 |
| WO | WO 01/71358 | 9/2001 |
| WO | WO 01/71358 A1 * | 9/2001 |
| WO | WO 01/96395 | 12/2001 |
| WO | WO 02/00677 | 1/2002 |
| WO | WO 02/09735 | 2/2002 |
| WO | WO 02/12476 | 2/2002 |
| WO | WO 02/25285 | 3/2002 |
| WO | WO 02/32940 | 4/2002 |
| WO | WO 02/42444 | 5/2002 |
| WO | WO 02/46465 | 6/2002 |
| WO | WO 02/059271 | 8/2002 |
| WO | WO 02/068677 | 9/2002 |
| WO | WO 02/071928 | 9/2002 |
| WO | WO 02/072759 | 9/2002 |
| WO | WO 02/077183 | 10/2002 |
| WO | WO 02/081522 | 10/2002 |
| WO | WO 02/086443 | 10/2002 |
| WO | WO 02/090974 | 11/2002 |
| WO | WO 02/092122 | 11/2002 |
| WO | WO 02/097127 | 12/2002 |
| WO | WO 02/101075 | 12/2002 |
| WO | WO 03/004989 | 1/2003 |
| WO | WO 03/008540 | 1/2003 |
| WO | WO 03/009814 | 2/2003 |
| WO | WO 03/016475 | 2/2003 |
| WO | WO 03/023401 | 3/2003 |
| WO | WO 03/024392 | 3/2003 |
| WO | WO 03/027151 | 4/2003 |
| WO | WO 03/030925 | 4/2003 |
| WO | WO 03/042661 | 5/2003 |
| WO | WO 03/047526 | 6/2003 |
| WO | WO 03/048304 | 6/2003 |
| WO | WO 03/072827 | 9/2003 |
| WO | WO 03/083039 | 10/2003 |
| WO | WO 03/100007 | 12/2003 |
| WO | WO 2004/013311 | 2/2004 |
| WO | WO 2004/018647 | 3/2004 |
| WO | WO 2004/018648 | 3/2004 |
| WO | WO 2004/023973 | 3/2004 |
| WO | WO 2004/030615 | 4/2004 |
| WO | WO 2004/035798 | 4/2004 |
| WO | WO 2004/041170 | 5/2004 |
| WO | WO 2004/044178 | 5/2004 |
| WO | WO 2004/053079 | 6/2004 |
| WO | WO 2004/076614 | 9/2004 |
| WO | WO 2004/080148 | 9/2004 |
| WO | WO 2004/090547 | 10/2004 |
| WO | WO 2004/092338 | 10/2004 |
| WO | WO 2004/103403 | 12/2004 |
| WO | WO 2004/110345 | 12/2004 |
| WO | WO 2005/032328 | 4/2005 |
| WO | WO 2006/131783 | 12/2006 |

OTHER PUBLICATIONS

NCBI Genbank Accession No. P10451 [gi:129260] with Revision History—Dec. 1, 1992-Jun. 15, 2002.
NCBI Genbank Accession No. BAC11635 [gi:22761565] with Revision History—Sep. 3, 2002.
NCBI Genbank Accession No. BAA05951 [gi:992950] with Revision History—Sep. 20, 1995-Feb. 8, 2003.
NCBI Genbank Accession No. BAA05949 [gi:992948] with Revision History—Sep. 20, 1995-Feb. 8, 2003.
NCBI Genbank Accession No. BAA05950 [GI:992949] with Revision History—Sep. 20, 1995-Feb. 8, 2003.
Chaplet et al., Journal of Bone and Mineral Research 2003 18 : 1506-1512.
Takahashi et al., Lung Cancer 2003 41 : 145-153.
Sørensen et al., Protein Expression and Purification 2003 30:238-245.
Pérez et al., Journal of Structural Biology 2003 143:1-13.
Masutani et al., Clinical Nephrology 2003 59(6) :395-405.
Koguchi et al., Am J Respir Crit Care Med 2003 167:1355-1359.
Saika et al., Invest Ophthalmol Vis Sci 2003 44:1622-1628.
Ye et al., Nature Medicine 2003 9(4) :416-423.
Tuck et al., Oncogene 2003 22:1198-1205.
Mouri et al., Cell Biology International 2003 27:519-524.
Postiglione et al., European Journal of Histochemistry 2003 47(4) :309-316.
Khanna et al., Kidney International 2002 62:2257-2263.
Wilder R.L., Ann Rheum Dis 2002 61:ii96-ii99.
Uchio et al., Graefe's Arch Clin Exp Ophthalmol 2002 240:924-928.
Sulzbacher et al., Virchows Arch 2002 441:345-349.
Faccio et al., J Cell Sciences 2002 115:2919-2929.
Rudland et al., Cancer Research 2002 62:3417-3427.
Pepinsky et al., Biochemistry 2002 41:7125-7141.
Lai et al., J Biol Chem 2002 277(18) :15514-15522.

Kaimori et al., American Journal of Kidney Diseases 2002 39(5) :948-957.
Kon et al., J Cell Biochem 2002 84:420-432.
Nitta et al., Clinical Nephrology 2001 56(6) :459-466.
Philip et al., J Biol Chem 2001 276(48) :44926-44935.
Gaumann et al., Virchows Arch 2001 439:668-674.
Sakata et al., J Rheumatol 2001 28(7) :1492-1495.
Iizuka et al., Biochem Biophys Res Commun 2001 283(2) :493-498.
Cummings et al., Arch Pathol Lab Med 2001 125:637-641.
Ninomiya et al., J Endod 2001 27(4) :269-272.
Cheng et al., J Bone Miner Res 2001 16:277-288.
Baron et al., Cardiovascular Research 2000 48:464-472.
Noti, J. D., Int J Oncol 2000 17(6) :1237-1243.
Wang et al., Oncogene 2000 19:5801-5809.
O'Regan et al., J Leukoc Biol 2000 68:495-502.
Pullig et al., Matrix Biology 2000 19:245-255.
Bendeck et al., Arterioscler Thromb Vasc Biol 2000 20:1467-1472.
Takano et al., British Journal of Cancer 2000 82(12) :1967-1973.
Kon et al., J Cell Bio Chem 2000 77:487-498.
Lin et al., Molecular and Cellular Biology 2000 20(8) :2734-2742.
Attur et al., J Immunol 2000 164:2684-2691.
Lecrone et al., Cell Calcium 2000 27(1) :35-42.
Fujisaki et al., 2000 75(1 ):45-52 (Abstract only).
Yokosaki et al., J Biol Chem 1999 274(51) :36328-36334.
Caltabiano et al., Biochemical Pharmacology 1999 58:1567-1578.
Fierabracci et al., Vaccine 2000 18:342-354.
Thalmann et al., Clinical Cancer Research 1999 5:2271-2277.
Tawada et al., Urol Res 1999 27:238-242.
Higuchi et al., Bone 1999 25(1) :17-24.
Koistinen et al., Matrix Biology 1999 18:239-251.
Koszewski et al., J Bone Miner Res 1999 14(4):509-517.
Oyajobi et al., J Bone Miner Res 1999 14(3) :351-361.
Cancel et al., Biology of Reproduction 1999 60:454-460.
Byers et al., J Pathol 1999 187(3):374-381.
Takahashi et al., Int J Cancer 1999 80:387-395.
Gronthos et al., J Bone Miner Res 1999 14(1):47-56.
Iizuka et al., Lab Invest 1998 78(12):1523-1533.
Rittling et al., Biochem Biophys Res Commun 1998 250(2):287-292.
Iizuka et al., Hokkaido Igaku Zasshi 1998 73(5) :487-495 (Abstract only).
Faccio et al., Biochem Biophys Res Commun 1998 249:522-525.
Alvarez-Pérez et al., J Periodont Res 1998 33:249-258.
Bayless et al., J Cell Sci 1998 111:1165-1174.
Elgavish et al., The Prostate 1998 35:83-94.
Binette et al., J Orthopaedic Res 1998 16(2) :207-216.
Kim et al., Eur J Oral Sci 1998 106 (suppl 1) :408-417.
Teti et al., J Bone Miner Res 1998 13(1) :50-58.
Yu et al., Proc Assoc Am Physicians 1998 110(1) :50-64.
Omigbodun et al., Endocrinology 1997 138(10) :4308-4315.
Gladson et al., Am J Pathol 1997 150(5) :1631-1646.
Nishikawa et al., J Periodont Res 1997 32:355-361.
Devoll et al., Calcif Tissue Int 1997 60:380-386.
Naor et al., Adv Cancer Res 1997 71:241-319.
Liaw et al., Arteriosclerosis, Thrombosis, and Vascular Biology 1997 17:188-193.
Senger et al., Biochim Biophys Acta 1996 1314(1-2) :13-24.
James et al., J Bone Miner Res 1996 11(11) :1608-1618.
Chambers et al.,Lung Cancer 1996 15:311-323.
Staal et al., Mol Endocrinol 1996 10:1444-1456.
Katagiri et al., J Cell Biochem 1996 62:123-131.
Chellaiah et al., Endocrinology 1996 137:2432-2440.
Bautista et al., J Cell Biochem 1996 61:402-409.
Wu et al., J Bone Miner Res 1996 11 (5) :686-692.
Ito et al., Nippon Hinyokika Gakkai Zasshi 1996 87 (5) :865-874 (Abstract only).
Aarden et al., Bone 1996 18(4) :305-313.
Andersson et al., Connect Tissue Res 1996 35(1-4) :163-171.
Hu et al., J Biol Chem 1995 270(44) :26232-26238.
Hirota et al., J Neuropathol Exp Neurol 1995 54 (5) :698-703.
Hsieh et al., J Steroid Biochem Molec Biol 1995 53(1-6):583-594.
Omigbodun et al., Ann N Y Acad Sci 1995 760:346-349.
Jääskeläinen et al., Eur J Biochem 1995 228:222-228.
Liaw et al., J Clin Invest 1995 95:713-724.
D'Errico et al., J Periodont Res 1995 30:34-41.
Hirota et al.., Laboratory Investigation 1995 72 (1) :64-69.
Saitoh et al., Laboratory Investigation 1995 72 (1) :55-63.
Maeda et al., Histochemistry 1994 102:247-254.
Bautista et al., J Biol Chem 1994 269 (37) :23280-23285.
Grano et al., Exp Cell Res 1994 212:209-218.
Senger et al., Mol Biol Cell 1994 5:565-574.
Couser et al., Am J Kidney Dis 1994 23 (2) :193-198.
Hoyer, J. R., Miner Electrolyte Metab 1994 20 :385-392.
Moriwaka et al., Acta Neurol Scand 1993 88 :184-189.
Loesser, R. F., Arthritis and Rheumatism 1993 36(8) :1103-1110.
Ross et al., J Biol Chem 1993 268 (13) :9901-9907.
Miyagishi et al., Rinsho Shinkeigaku 1992 32(10):1121-1124 (Abstract only).
Pacifici et al., J Clin Invest 1991 87 :221-228.
Somerman et al., J Biol Buccale 1990 18 :207-214.
Senger et al., Biochim Biophys Acta 1989 996(1-2) :43-48.
Hijiya et al., Biochem J 1994 303 :255-262.
Kiefer et al., Nucleic Acids Research 1989 17(8) :3306.
Young et al., Genomics 1990 7 :491-502.
Fisher et al., J Biol Chem 1990 265 (4) :2347-2351.
Shiraga et al., Proc Natl Acad Sci USA 1992 89 :426-430.
Kohri et al., Biochem Biophys Res Commun 1992 184 (2) :859-864.
Crosby et al., Genomics 1995 27 :155-160.
Crosby et al., Mammalian Genome 1996 7 :149-151.
Jono et al., J Biol Chem 2000 275 (26) :20197-20203.
Valabrega et al., British Journal of Cancer 2003 88:396-400.
Nakamura et al., Pancreas 2002 25 (2) :182-187.
Frank et al., J Cell Biochem 2002 85 :737-746.
Kim et al., JAMA 2002 287 (13) :1671-1679.
Koguchi et al., Infect Immun 2002 70 (3) :1042-1048.
Oyama et al., Cir Res 2002 90:348-355.
Gotoh et al., Pathology International 2002 52:19-24.
Angelucci et al., Biol Chem 2002 383:229-234.
Urquidi et al., Clin Cancer Res 2002 8:61-74.
Chabas et al., Science 2001 294:1731-1735.
Denhardt et al., Clin Exp Metastasis 2003 20:77-84.
Verhulst et al., J Am Soc Nephrol 2003 13:107-115.
Das et al., J Biol Chem 2003 278(31) :28593-28606.
Wang-Rodriquez et al., Breast Cancer Resarch 2003 5(5) :R136-R143.
Carlinfante et al., Clin Exp Metastasis 2003 20:437-444.
Lasa et al.,Biochem Biophys Res Commun 1997 240 (3) :602-605.
Bidder et al., J Biol Chem 2002 277(46) :44485-44496.
Gauer et al., Am J Hypertens 2003 16(3) :214-222.
Kelly et al., Nephrol Dial Transplant 2002 17:985-991.
Luedtke et al., Biol Reprod 2002 66:1437-1448.
Razzouk et al., Bone 2002 30 (1):40-47.
Yu et al., J. Invest Dermatol 2001 17:1554-1558.
Zhu et al., Biochem Cell Biol 2001 79:737-746.
Renault et al., J Biol Chem 2005 280(40):2708-2713.
Philip et al., J Biol Chem 2003 278(16):14487-14497.
Zhang et al., Mol Cell Biol 2003 23(18) :6507-6519.
Weber et al., J Leukoc Biol 2002 72(4) :752-761.
Ono et al., Mol lmmunol 1995 32 (6) :447-448.
Zhu et al., J Cell Physiol 2004 198:155-167.
Ariztia et al., Exp Cell Res 2003 288:257-267.
Leali et al., J Immunol 2003 171:1085-1093.
Wu et al., Biochim Biophys Acta 2003 1641:65-70.
Kim et al., J Cell Biochem 2002 87 :93-102.
Teramoto et al., Oncogene 2005 24:489-501.
Ashkar et al., Science 2000 87:860-864.
Yoshida et al., Nature Genetics 2002 32:633-638.
Maes et al., Mech Dev 2002 111:61-73.
Nakashima et al., Cell 2002 108:17-29.
Kovacs et al., Endocrinology 2001 142 (11) :4983-4993.
Colnot et al., Mech Dev 2001 100:245-250.
Inada et al., Proc Natl Acad Sci USA 2004 101 (49) :17192-17197.
Yu et al., Development 2003 130:3063-3074.
Chung et al., J Clin Invest 2001 107 (3) :295-304.
Inman et al., J Biol Chem 2003 278 (49) :48684-48689.
Beck et al., J Biol Chem 2003 278 (43) :41921-41929.
Morinobu et al., J Bone Miner Res 2003 18 (9) :1706-1715.

Miller et al., Nature Genetics 2002 32:645-649.
Rittling et al., J Biol Chem 2002 277 (11):9175-9182.
Weber, G. F., Biochimica et Biophysica Acta 2001 1552:61-85.
Lin et al., J Biol Chem 2001 276 (49):46024-46030.
Weber et al., Clin Exp Immunol 2001 126:578-583.
Ihara et al., J Biol Chem 2001 276(16):13065-13071.
Nemir et al., J Biol Chem 2000 275 (2):969-976.
Sato et al., Oncogene 1998 17:1517-1525.
Patarca et al., Crit Rev Immunol 1993 13 (3/4):225-246.
NCBI Genbank Accession No. AC131944 [gi:22507269] with Revision History—Aug. 27, 2002 -May 13, 2005.
NCBI Genbank Accession No. D14813 [gi:506341] with Revision History—Feb. 15, 1995-May 29, 2002.
NCBI Genbank Accession No. BC017387 [gi:16924232] with Revision History—Nov. 14, 2001-Jul. 21, 2005.
NCBI Genbank Accession No. BC007016 [gi:13937828] with Revision History—May 3, 2001-Jun. 24, 2004.
NCBI Genbank Accession No. AF052124 [gi:3360431] with Revision History—Jul. 31, 1998-Aug. 5, 1998.
NCBI Genbank Accession No. X13694 [gi:35147] with Revision History—Jul. 6, 1989-Mar. 22, 1995.
NCBI Genbank Accession No. J04765 [gi:189404] with Revision History—Oct. 30, 1991-Jan. 7, 1995.
NCBI Genbank Accession No. NM_ 000582 [gi:38146097] with Revision History—Dec. 23, 2003-Oct. 27, 2004.
NCBI Genbank Accession No. BC022844 [gi:18606298] with Revision History—Feb. 7, 2002-Jun. 29, 2004.
NCBI Genbank Accession No. AK057738 [gi:16553662] with Revision History—Oct. 31, 2001-Sep. 13, 2006.

* cited by examiner

COMPOSITIONS AND METHODS RELATING TO OVARIAN SPECIFIC GENES AND PROTEINS

This application is the U.S. National Stage of PCT Application PCT/US2003/024669, filed Aug. 6, 2003, which claims the benefit of priority to U.S. Provisional Application Ser. No. 60/401,469, filed Aug. 6, 2002, each of which are herein incorporated by reference in their entirety.

FIELD OF THE INVENTION

The present invention relates to newly identified nucleic acids and polypeptides present in normal and neoplastic ovarian cells, including fragments, variants and derivatives of the nucleic acids and polypeptides. The present invention also relates to antibodies to the polypeptides of the invention, as well as agonists and antagonists of the polypeptides of the invention. The invention also relates to compositions comprising the nucleic acids, polypeptides, antibodies, post translational modifications (PTMs), variants, derivatives, agonists and antagonists of the invention and methods for the use of these compositions. These uses include identifying, diagnosing, monitoring, staging, imaging and treating ovarian cancer and non-cancerous disease states in ovarian, identifying ovarian tissue and monitoring and identifying and/or designing agonists and antagonists of polypeptides of the invention. The uses also include gene therapy, therapeutic molecules including but limited to antibodies or antisense molecules, production of transgenic animals and cells, and production of engineered ovarian tissue for treatment and research.

BACKGROUND OF THE INVENTION

Cancer of the ovaries is the fourth-most common cause of cancer death in women in the United States, with more than 23,000 new cases and roughly 14,000 deaths predicted for the year 2001. Shridhir, V. et al., *Cancer Res.* 61(15): 5895-904 (2001); Memarzadeh, S. & Berek, J. S., *J. Reprod. Med.* 46(7): 621-29 (2001). The incidence of ovarian cancer is of serious concern worldwide, with an estimated 191,000 new cases predicted annually. Runnebaum, I. B. & Stickeler, E., *J. Cancer Res. Clin. Oncol.* 127(2): 73-79 (2001). Unfortunately, women with ovarian cancer are typically asymptomatic until the disease has metastasized. Because effective screening for ovarian cancer is not available, roughly 70% of women diagnosed have an advanced stage of the cancer with a five-year survival rate of 25-30%. Memarzadeh, S. & Berek, J. S., supra; Nunns, D. et al., *Obstet. Gynecol. Surv.* 55(12): 746-51. Conversely, women diagnosed with early stage ovarian cancer enjoy considerably higher survival rates. Werness, B. A. & Eltabbakh, G. H., *Int'l. J. Gynecol. Pathol.* 20(1): 48-63 (2001). Although our understanding of the etiology of ovarian cancer is incomplete, the results of extensive research in this area point to a combination of age, genetics, reproductive, and dietary/environmental factors. Age is a key risk factor in the development of ovarian cancer: while the risk for developing ovarian cancer before the age of 30 is slim, the incidence of ovarian cancer rises linearly between ages 30 to 50, increasing at a slower rate thereafter, with the highest incidence being among septagenarian women. Jeanne M. Schilder et al., Hereditary Ovarian Cancer: Clinical Syndromes and Management, in *Ovarian Cancer* 182 (Stephen C. Rubin & Gregory P. Sutton eds., 2d ed. 2001).

With respect to genetic factors, a family history of ovarian cancer is the most significant risk factor in the development of the disease, with that risk depending on the number of affected family members, the degree of their relationship to the woman, and which particular first degree relatives are affected by the disease. Id. Mutations in several genes have been associated with ovarian cancer, including BRCA1 and BRCA2, both of which play a key role in the development of breast cancer, as well as hMSH2 and hMLH1, both of which are associated with hereditary non-polyposis colon cancer. Katherine Y. Look, Epidemiology, Etiology, and Screening of Ovarian Cancer, in *Ovarian Cancer* 169, 171-73 (Stephen C. Rubin & Gregory P. Sutton eds., 2d ed. 2001). BRCA1, located on chromosome 17, and BRCA2, located on chromosome 13, are tumor suppressor genes implicated in DNA repair; mutations in these genes are linked to roughly 10% of ovarian cancers. Id. at 171-72; Schilder et al., supra at 185-86. hMSH2 and hMLH1 are associated with DNA mismatch repair, and are located on chromosomes 2 and 3, respectively; it has been reported that roughly 3% of hereditary ovarian carcinomas are due to mutations in these genes. Look, supra at 173; Schilder et al., supra at 184, 188-89.

Reproductive factors have also been associated with an increased or reduced risk of ovarian cancer. Late menopause, nulliparity, and early age at menarche have all been linked with an elevated risk of ovarian cancer. Schilder et al., supra at 182. One theory hypothesizes that these factors increase the number of ovulatory cycles over the course of a woman's life, leading to "incessant ovulation," which is thought to be the primary cause of mutations to the ovarian epithelium. Id.; Laura J. Havrilesky & Andrew Berchuck, Molecular Alterations in Sporadic Ovarian Cancer, in *Ovarian Cancer* 25 (Stephen C. Rubin & Gregory P. Sutton eds., 2d ed. 2001). The mutations may be explained by the fact that ovulation results in the destruction and repair of that epithelium, necessitating increased cell division, thereby increasing the possibility that an undetected mutation will occur. Id. Support for this theory may be found in the fact pregnancy, lactation, and the use of oral contraceptives, all of which suppress ovulation, confer a protective effect with respect to developing ovarian cancer. Id.

Among dietary/environmental factors, there would appear to be an association between high intake of animal fat or red meat and ovarian cancer, while the antioxidant Vitamin A, which prevents free radical formation and also assists in maintaining normal cellular differentiation, may offer a protective effect. Look, supra at 169; Reports have also associated asbestos and hydrous magnesium trisilicate (talc), the latter of which may be present in diaphragms and sanitary napkins. Id. at 169-70.

Current screening procedures for ovarian cancer, while of some utility, are quite limited in their diagnostic ability, a problem that is particularly acute at early stages of cancer progression when the disease is typically asymptomatic yet is most readily treated. Walter J. Burdette, *Cancer: Etiology, Diagnosis, and Treatment* 166 (1998); Memarzadeh & Berek, supra; Runnebaum & Stickeler, supra; Werness & Eltabbakh, supra. Commonly used screening tests include biannual rectovaginal pelvic examination, radioimmunoassay to detect the CA-125 serum tumor marker, and transvaginal ultrasonography. Burdette, supra at 166.

Pelvic examination has failed to yield adequate numbers of early diagnoses, and the other methods are not sufficiently accurate. Id. One study reported that only 15% of patients who suffered from ovarian cancer were diagnosed with the disease at the time of their pelvic examination. Look, supra at 174. Moreover, the CA-125 test is prone to giving false positives in pre-menopausal women and has been reported to be of low predictive value in post-menopausal women. Id. at 174-75. Although transvaginal ultrasonography is now the preferred procedure for screening for ovarian cancer, it is unable to distinguish reliably between benign and malignant tumors, and also cannot locate primary peritoneal malignancies or ovarian cancer if the ovary size is normal. Schilder et al., supra at 194-95. While genetic testing for mutations of the BRCA1, BRCA2, hMSH2, and hMLH1 genes is now available, these tests may be too costly for some patients and may also yield false negative or indeterminate results. Schilder et al., supra at 191-94.

The staging of ovarian cancer, which is accomplished through surgical exploration, is crucial in determining the course of treatment and management of the disease. *AJCC Cancer Staging Handbook* 187 (Irvin D. Fleming et al. eds., 5th ed. 1998); Burdette, Supra at 170; Memarzadeh & Berek, supra; Shridhar et al., supra. Staging is performed by reference to the classification system developed by the International Federation of Gynecology and Obstetrics. David H. Moore, Primary Surgical Management of Early Epithelial Ovarian Carcinoma, in *Ovarian Cancer* 203 (Stephen C. Rubin & Gregory P. Sutton eds., 2d ed. 2001); Fleming et al. eds., supra at 188. Stage I ovarian cancer is characterized by tumor growth that is limited to the ovaries and is comprised of three substages. Id. In substage IA, tumor growth is limited to one ovary, there is no tumor on the external surface of the ovary, the ovarian capsule is intact, and no malignant cells are present in ascites or peritoneal washings. Id. Substage IB is identical to A1, except that tumor growth is limited to both ovaries. Id. Substage IC refers to the presence of tumor growth limited to one or both ovaries, and also includes one or more of the following characteristics: capsule rupture, tumor growth on the surface of one or both ovaries, and malignant cells present in ascites or peritoneal washings. Id.

Stage II ovarian cancer refers to tumor growth involving one or both ovaries, along with pelvic extension. Id. Substage IIA involves extension and/or implants on the uterus and/or fallopian tubes, with no malignant cells in the ascites or peritoneal washings, while substage IIB involves extension into other pelvic organs and tissues, again with no malignant cells in the ascites or peritoneal washings. Id. Substage IIC involves pelvic extension as in IIA or IIB, but with malignant cells in the ascites or peritoneal washings. Id.

Stage III ovarian cancer involves tumor growth in one or both ovaries, with peritoneal metastasis beyond the pelvis confirmed by microscope and/or metastasis in the regional lymph nodes. Id. Substage IIIA is characterized by microscopic peritoneal metastasis outside the pelvis, with substage IIIB involving macroscopic peritoneal metastasis outside the pelvis 2 cm or less in greatest dimension. Id. Substage IIIC is identical to IIIB, except that the metastasis is greater than 2 cm in greatest dimension and may include regional lymph node metastasis. Id. Lastly, Stage IV refers to the presence distant metastasis, excluding peritoneal metastasis. Id.

While surgical-staging is currently the benchmark for assessing the management and treatment of ovarian cancer, it suffers from considerable drawbacks, including the invasiveness of the procedure, the potential for complications, as well as the potential for inaccuracy. Moore, supra at 206-208, 213. In view of these limitations, attention has turned to developing alternative staging methodologies through understanding differential gene expression in various stages of ovarian cancer and by obtaining various biomarkers to help better assess the progression of the disease. Vartiainen, J. et al., *Int'l J. Cancer*, 95(5): 313-16 (2001); Shridhar et al. supra; Baekelandt, M. et al., *J. Clin. Oncol.* 18(22): 3775-81.

The treatment of ovarian cancer typically involves a multiprong attack, with surgical intervention serving as the foundation of treatment. Dennis S. Chi & William J. Hoskins, Primary Surgical Management of Advanced Epithelial Ovarian Cancer, in *Ovarian Cancer* 241 (Stephen C. Rubin & Gregory P. Sutton eds., 2d ed. 2001). For example, in the case of epithelial ovarian cancer, which accounts for ~90% of cases of ovarian cancer, treatment typically consists of: (1) cytoreductive surgery, including total abdominal hysterectomy, bilateral salpingo-oophorectomy, omentectomy, and lymphadenectomy, followed by (2) adjuvant chemotherapy with paclitaxel and either cisplatin or carboplatin. Eltabbakh, G. H. & Awtrey, C. S., Expert Op. *Pharmacother.* 2(10): 109-24. Despite a clinical response rate of 80% to the adjuvant therapy, most patients experience tumor recurrence within three years of treatment. Id. Certain patients may undergo a second cytoreductive surgery and/or second-line chemotherapy. Memarzadeh & Berek, supra.

From the foregoing, it is clear that procedures used for detecting, diagnosing, monitoring, staging, prognosticating, and preventing the recurrence of ovarian cancer are of critical importance to the outcome of the patient. Moreover, current procedures, while helpful in each of these analyses, are limited by their specificity, sensitivity, invasiveness, and/or their cost. As such, highly specific and sensitive procedures that would operate by way of detecting novel markers in cells, tissues, or bodily fluids, with minimal invasiveness and at a reasonable cost, would be highly desirable.

SUMMARY OF THE INVENTION

The present invention solves many needs in the art by providing nucleic acid molecules, polypeptides and antibodies thereto, variants and derivatives of the nucleic acids and polypeptides, agonists and antagonists that may be used to identify, diagnose, monitor, stage, image and treat ovarian cancer and non-cancerous disease states in ovarian; identify and monitor ovarian tissue; and identify and design agonists and antagonists of polypeptides of the invention. The invention also provides gene therapy, methods for producing transgenic animals and cells, and methods for producing engineered ovarian tissue for treatment and research.

One aspect of the present invention relates to nucleic acid molecules that are specific to ovarian cells, ovarian tissue and/or the ovarian organ. These ovarian specific nucleic acids (OSNAs) may be a naturally occurring cDNA, genomic DNA, RNA, or a fragment of one of these nucleic acids, or may be a non-naturally occurring nucleic acid molecule. If the OSNA is genomic DNA, then the OSNA is a ovarian specific gene (OSG). If the OSNA is RNA, then it is a ovarian specific transcript encoded by a OSG. Due to alternative splicing and transcriptional modification one OSG may encode for multiple ovarian specific RNAs. In a preferred embodiment, the nucleic acid molecule encodes a polypeptide that is specific to ovarian. More preferred is a nucleic acid molecule that encodes a polypeptide comprising an amino acid sequence of SEQ ID NO: 249-396. In another preferred embodiment, the nucleic acid molecule comprises a nucleic acid sequence of SEQ ID NO: 1-248. For the OSNA sequences listed herein, DEX0443_001.nt.1 corresponds to SEQ ID NO: 1. For sequences with multiple splice variants, the parent sequence DEX0443_001.nt.1, will be followed by DEX0443_001.nt.2, etc. for each splice variant. The sequences off the corresponding peptides are listed as DEX0443_001.aa.1, etc. For the mapping of all of the nucleotides and peptides, see the table in the Example 1 section below.

This aspect of the present invention also relates to nucleic acid molecules that selectively hybridize or exhibit substantial sequence similarity to nucleic acid molecules encoding a Ovarian Specific Protein (OSP), or that selectively hybridize or exhibit substantial sequence similarity to a OSNA. In one embodiment of the present invention the nucleic acid molecule comprises an allelic variant of a nucleic acid molecule encoding a OSP, or an allelic variant of a OSNA. In another embodiment, the nucleic acid molecule comprises a part of a nucleic acid sequence that encodes a OSP or a part of a nucleic acid sequence of a OSNA.

In addition, this aspect of the present invention relates to a nucleic acid molecule further comprising one or more expression control sequences controlling the transcription and/or translation of all or a part of a OSNA or the transcription and/or translation of a nucleic acid molecule that encodes all or a fragment of a OSP.

Another aspect of the present invention relates to vectors and/or host cells comprising a nucleic acid molecule of this invention. In a preferred embodiment, the nucleic acid molecule of the vector and/or host cell encodes all or a fragment of a OSP. In another preferred embodiment, the nucleic acid molecule of the vector and/or host cell comprises all or a part of a OSNA. Vectors and host cells of the present invention are useful in the recombinant production of polypeptides, particularly OSPs of the present invention.

Another aspect of the present invention relates to polypeptides encoded by a nucleic acid molecule of this invention. The polypeptide may comprise either a fragment or a full-length protein. In a preferred embodiment, the polypeptide is a OSP. However, this aspect of the present invention also relates to mutant proteins (muteins) of OSPs, fusion proteins of which a portion is a OSP, and proteins and polypeptides encoded by allelic variants of a OSNA as provided herein.

A further aspect of the present invention is a splice variant which encodes an amino acid sequence that provides a region to be targeted for the generation of reagents that can be used in the detection and/or treatment of cancer. The amino acid sequence may lead to a unique protein structure, protein subcellular localization, biochemical processing or function. This information can be used to directly or indirectly facilitate the generation of additional or novel therapeutics or diagnostics. The nucleotide sequence in this splice variant can be used as a nucleic acid probe for the diagnosis and/or treatment of cancer.

Another aspect of the present invention relates to antibodies and other binders that specifically bind to a polypeptide of the instant invention. Accordingly antibodies or binders of the present invention specifically bind to OSPs, muteins, fusion proteins, and/or homologous proteins or polypeptides encoded by allelic variants of an OSNA as provided herein.

Another aspect of the present invention relates to agonists and antagonists of the nucleic acid molecules and polypeptides of this invention. The agonists and antagonists of the instant invention may be used to treat ovarian cancer and non-cancerous disease states in ovarian and to produce engineered ovarian tissue.

Another aspect of the present invention relates to methods for using the nucleic acid molecules to detect or amplify nucleic acid molecules that have similar or identical nucleic acid sequences compared to the nucleic acid molecules described herein. Such methods are useful in identifying, diagnosing, monitoring, staging, imaging and treating ovarian cancer and non-cancerous disease states in ovarian. Such methods are also useful in identifying and/or monitoring ovarian tissue. In addition, measurement of levels of one or more of the nucleic acid molecules of this invention may be useful for diagnostics as part of panel in combination with known other markers, particularly those described in the ovarian cancer background section above.

Another aspect of the present invention relates to use of the nucleic acid molecules of this invention in gene therapy, for producing transgenic animals and cells, and for producing engineered ovarian tissue for treatment and research.

Another aspect of the present invention relates to methods for detecting polypeptides this invention, preferably using antibodies thereto. Such methods are useful to identify, diagnose, monitor, stage, image and treat ovarian cancer and non-cancerous disease states in ovarian. In addition, measurement of levels of one or more of the polypeptides of this invention may be useful to identify, diagnose, monitor, stage, image ovarian cancer in combination with known other markers, particularly those described in the ovarian cancer background section above. The polypeptides of the present invention can also be used to identify and/or monitor ovarian tissue, and to produce engineered ovarian tissue.

Yet another aspect of the present invention relates to a computer readable means of storing the nucleic acid and amino acid sequences of the invention. The records of the computer readable means can be accessed for reading and displaying of sequences for comparison, alignment and ordering of the sequences of the invention to other sequences. In addition, the computer records regarding the nucleic acid and/or amino acid sequences and/or measurements of their levels may be used alone or in combination with other markers to diagnose ovarian related diseases.

DETAILED DESCRIPTION OF THE INVENTION

Definitions and General Techniques

Unless otherwise defined herein, scientific and technical terms used in connection with the present invention shall have the meanings that are commonly understood by those of ordinary skill in the art. Further, unless otherwise required by context, singular terms shall include pluralities and plural terms shall include the singular. Generally, nomenclatures used in connection with, and techniques of, cell and tissue culture, molecular biology, immunology, microbiology, genetics and protein and nucleic acid chemistry and hybridization described herein are those well known and commonly used in the art. The methods and techniques of the present invention are generally performed according to conventional methods well known in the art and as described in various general and more specific references that are cited and discussed throughout the present specification unless otherwise indicated. See, e.g., Sambrook et al., *Molecular Cloning: A Laboratory Manual*. 2d ed., Cold Spring Harbor Laboratory Press (1989) and Sambrook et al., *Molecular Cloning: A Laboratory Manual* 3d ed., Cold Spring Harbor Press (2001); Ausubel et al., *Current Protocols in Molecular Biology*, Greene Publishing Associates (1992, and Supplements to 2000); Ausubel et al., *Short Protocols in Molecular Biology: A Compendium of Methods from Current Protocols in Molecular Biology—4$^{th}$ Ed.* Wiley & Sons (1999); Harlow and Lane, *Antibodies: A Laboratory Manual*, Cold Spring Harbor Laboratory Press (1990); and Harlow and Lane, *Using Antibodies: A Laboratory Manual*, Cold Spring Harbor Laboratory Press (1999).

Enzymatic reactions and purification techniques are performed according to manufacturer's specifications, as commonly accomplished in the art or as described herein. The nomenclatures used in connection with, and the laboratory procedures and techniques of, analytical chemistry, synthetic organic chemistry, and medicinal and pharmaceutical chemistry described herein are those well known and commonly used in the art. Standard techniques are used for chemical syntheses, chemical analyses, pharmaceutical preparation, formulation, and delivery, and treatment of patients.

The following terms, unless otherwise indicated, shall be understood to have the following meanings:

A "nucleic acid molecule" of this invention refers to a polymeric form of nucleotides and includes both sense and antisense strands of RNA, cDNA, genomic DNA, and synthetic forms and mixed polymers of the above. A nucleotide refers to a ribonucleotide, deoxynucleotide or a modified form of either type of nucleotide. A "nucleic acid molecule" as used herein is synonymous with "nucleic acid" and "polynucleotide." The term "nucleic acid molecule" usually refers to a molecule of at least 10 bases in length, unless otherwise specified. The term includes single and double stranded forms of DNA. In addition, a polynucleotide may include either or both naturally occurring and modified nucleotides linked together by naturally occurring and/or non-naturally occurring nucleotide linkages.

Nucleotides are represented by single letter symbols in nucleic acid molecule sequences. The following table lists symbols identifying nucleotides or groups of nucleotides which may occupy the symbol position on a nucleic acid molecule. See Nomenclature Committee of the International Union of Biochemistry (NC-IUB), Nomenclature for incompletely specified bases in nucleic acid sequences, Recommendations 1984, *Eur J Biochem.* 150(1):1-5 (1985).

| Symbol | Meaning | Group/origin of Designation | Complementary Symbol |
|---|---|---|---|
| a | a | Adenine | t/u |
| g | g | Guanine | c |
| c | c | Cytosine | g |
| t | t | Thymine | a |
| u | u | Uracil | a |
| r | g or a | puRine | y |
| y | t/u or c | pYrimidine | r |
| m | a or c | aMino | k |
| k | g or t/u | Keto | m |
| s | g or c | Strong interactions 3H-bonds | w |
| w | a or t/u | Weak interactions 2H-bonds | s |
| b | g or c or t/u | not a | v |
| d | a or g or t/u | not c | h |
| h | a or c or t/u | not g | d |
| v | a or g or c | not t, not u | b |
| n | a or g or c or t/u | aNy unknown, or other | n |

The nucleic acid molecules may be modified chemically or biochemically or may contain non-natural or derivatized nucleotide bases, as will be readily appreciated by those of skill in the art. Such modifications include, for example, labels, methylation, substitution of one or more of the naturally occurring nucleotides with an analog, internucleotide modifications such as uncharged linkages (e.g., methyl phosphonates, phosphotriesters, phosphoramidates, carbamates, etc.), charged linkages (e.g., phosphorothioates, phosphorodithioates, etc.), pendent moieties (e.g., polypeptides), intercalators (e.g., acridine, psoralen, etc.), chelators, alkylators, and modified linkages (e.g., alpha anomeric nucleic acids, etc.) The term "nucleic acid molecule" also includes any topological conformation, including single-stranded, double-stranded, partially duplexed, triplexed, hairpinned, circular and padlocked conformations. Also included are synthetic molecules that mimic polynucleotides in their ability to bind to a designated sequence via hydrogen bonding and other chemical interactions. Such molecules are known in the art and include, for example, those in which peptide linkages substitute for phosphate linkages in the backbone of the molecule.

A "gene" is defined as a nucleic acid molecule that comprises a nucleic acid sequence that encodes a polypeptide and the expression control sequences that surround the nucleic acid sequence that encodes the polypeptide. For instance, a gene may comprise a promoter, one or more enhancers, a nucleic acid sequence that encodes a polypeptide, downstream regulatory sequences and, possibly, other nucleic acid sequences involved in regulation of the expression of an RNA. As is well known in the art, eukaryotic genes usually contain both exons and introns. The term "exon" refers to a nucleic acid sequence found in genomic DNA that is bioinformatically predicted and/or experimentally confirmed to contribute contiguous sequence to a mature mRNA transcript. The term "intron" refers to a nucleic acid sequence found in genomic DNA that is predicted and/or confirmed to not contribute to a mature mRNA transcript, but rather to be "spliced out" during processing of the transcript.

A nucleic acid molecule or polypeptide is "derived" from a particular species if the nucleic acid molecule or polypeptide has been isolated from the particular species, or if the nucleic acid molecule or polypeptide is homologous to a nucleic acid molecule or polypeptide isolated from a particular species.

An "isolated" or "substantially pure" nucleic acid or polynucleotide (e.g., an RNA, DNA or a mixed polymer) is one which is substantially separated from other cellular components that naturally accompany the native polynucleotide in its natural host cell, e.g. ribosomes, polymerases, or genomic sequences with which it is naturally associated. The term embraces a nucleic acid or polynucleotide that (1) has been removed from its naturally occurring environment, (2) is not associated with all or a portion of a polynucleotide in which the "isolated polynucleotide" is found in nature, (3) is operatively linked to a polynucleotide which it is not linked to in nature, (4) does not occur in nature as part of a larger sequence or (5) includes nucleotides or internucleoside bonds that are not found in nature. The term "isolated" or "substantially pure" also can be used in reference to recombinant or cloned DNA isolates, chemically synthesized polynucleotide analogs, or polynucleotide analogs that are biologically synthesized by heterologous systems. The term "isolated nucleic acid molecule" includes nucleic acid molecules that are integrated into a host cell chromosome at a heterologous site, recombinant fusions of a native fragment to a heterologous sequence, recombinant vectors present as episomes or as integrated into a host cell chromosome.

A "part" of a nucleic acid molecule refers to a nucleic acid molecule that comprises a partial contiguous sequence of at least 10 bases of the reference nucleic acid molecule. Preferably, a part comprises at least 15 to 20 bases of a reference nucleic acid molecule. In theory, a nucleic acid sequence of 17 nucleotides is of sufficient length to occur at random less frequently than once in the three gigabase human genome, and thus to provide a nucleic acid probe that can uniquely identify the reference sequence in a nucleic acid mixture of genomic complexity. A preferred part is one that comprises a nucleic acid sequence that can encode at least 6 contiguous amino acid sequences (fragments of at least 18 nucleotides) because they are useful in directing the expression or synthesis of peptides that are useful in mapping the epitopes of the polypeptide encoded by the reference nucleic acid. See, e.g., Geysen et al., *Proc. Natl. Acad. Sci. USA* 81:3998-4002 (1984); and U.S. Pat. Nos. 4,708,871 and 5,595,915, the disclosures of which are incorporated herein by reference in their entireties. A part may also comprise at least 25, 30, 35 or 40 nucleotides of a reference nucleic acid molecule, or at least 50, 60, 70, 80, 90, 100, 150, 200, 250, 300, 350, 400 or 500 nucleotides of a reference nucleic acid molecule. A part of a nucleic acid molecule may comprise no other nucleic acid sequences. Alternatively, a part of a nucleic acid may comprise other nucleic acid sequences from other nucleic acid molecules.

The term "oligonucleotide" refers to a nucleic acid molecule generally comprising a length of 200 bases or fewer. The term often refers to single-stranded deoxyribonucleotides, but it can refer as well to single- or double-stranded ribonucleotides, RNA:DNA hybrids and double-stranded DNAs, among others. Preferably, oligonucleotides are 10 to 60 bases in length and most preferably 12, 13, 14, 15, 16, 17, 18, 19 or 20 bases in length. Other preferred oligonucleotides are 25, 30, 35, 40, 45, 50, 55 or 60 bases in length. Oligonucleotides may be single-stranded, e.g. for use as probes or primers, or may be double-stranded, e.g. for use in the construction of a mutant gene. Oligonucleotides of the invention can be either sense or antisense oligonucleotides. An oligonucleotide can be derivatized or modified as discussed above for nucleic acid molecules.

Oligonucleotides, such as single-stranded DNA probe oligonucleotides, often are synthesized by chemical methods, such as those implemented on automated oligonucleotide synthesizers. However, oligonucleotides can be made by a variety of other methods, including in vitro recombinant DNA-mediated techniques and by expression of DNAs in cells and organisms. Initially, chemically synthesized DNAs typically are obtained without a 5' phosphate. The 5' ends of such oligonucleotides are not substrates for phosphodiester bond formation by ligation reactions that employ DNA ligases typically used to form recombinant DNA molecules. Where ligation of such oligonucleotides is desired, a phosphate can be added by standard techniques, such as those that employ a kinase and ATP. The 3' end of a chemically synthesized oligonucleotide generally has a free hydroxyl group and, in the presence of a ligase, such as T4 DNA ligase, readily will form a phosphodiester bond with a 5' phosphate of another polynucleotide, such as another oligonucleotide. As is well known, this reaction can be prevented selectively, where desired, by removing the 5' phosphates of the other polynucleotide(s) prior to ligation.

The term "naturally occurring nucleotide" referred to herein includes naturally occurring deoxyribonucleotides and ribonucleotides. The term "modified nucleotides" referred to herein includes nucleotides with modified or substituted sugar groups and the like. The term "nucleotide linkages" referred to herein includes nucleotides linkages such as phosphorothioate, phosphorodithioate, phosphoroselenoate, phosphorodiselenoate, phosphoroanilothioate, phoshoraniladate, phosphoroamidate, and the like. See e.g., LaPlanche et al. *Nucl. Acids Res.* 14:9081-9093 (1986); Stein et al. *Nucl. Acids Res.* 16:3209-3221 (1988); Zon et al. *Anti-Cancer Drug Design* 6:539-568 (1991); Zon et al., in Eckstein (ed.) *Oligonucleotides and Analogues: A Practical Approach*, pp. 87-108, Oxford University Press (1991); Uhlmann and Peyman *Chemical Reviews* 90:543 (1990), and U.S. Pat. No. 5,151,510, the disclosure of which is hereby incorporated by reference in its entirety.

Unless specified otherwise, the left hand end of a polynucleotide sequence in sense orientation is the 5' end and the right hand end of the sequence is the 3' end. In addition, the left hand direction of a polynucleotide sequence in sense orientation is referred to as the 5' direction, while the right, hand direction of the polynucleotide sequence is referred to as the 3' direction. Further, unless otherwise indicated, each nucleotide sequence is set forth herein as a sequence of deoxyribonucleotides. It is intended, however, that the given sequence be interpreted as would be appropriate to the polynucleotide composition: for example, if the isolated nucleic acid is composed of RNA, the given sequence intends ribonucleotides, with uridine substituted for thymidine.

The term "allelic variant" refers to one of two or more alternative naturally occurring forms of a gene, wherein each gene possesses a unique nucleotide sequence. In a preferred embodiment, different alleles of a given gene have similar or identical biological properties.

The term "percent sequence identity" in the context of nucleic acid sequences refers to the residues in two sequences which are the same when aligned for maximum correspondence. The length of sequence identity comparison may be over a stretch of at least about nine nucleotides, usually at least about 20 nucleotides, more usually at least about 24 nucleotides, typically at least about 28 nucleotides, more typically at least about 32 nucleotides, and preferably at least about 36 or more nucleotides. There are a number of different algorithms known in the art which can be used to measure nucleotide sequence identity. For instance, polynucleotide sequences can be compared using FASTA, Gap or Bestfit, which are programs in Wisconsin Package Version 10.0, Genetics Computer Group (GCG), Madison, Wis. FASTA, which includes, e.g., the programs FASTA2 and FASTA3, provides alignments and percent sequence identity of the regions of the best overlap between the query and search sequences (Pearson, *Methods Enzymol.* 183: 63-98 (1990); Pearson, *Methods Mol. Biol.* 132: 185-219 (2000); Pearson, *Methods Enzymol.* 266: 227-258 (1996); Pearson, *J. Mol. Biol.* 276: 71-84 (1998)). Unless otherwise specified, default parameters for a particular program or algorithm are used. For instance, percent sequence identity between nucleic acid sequences can be determined using FASTA with its default parameters (a word size of 6 and the NOPAM factor for the scoring matrix) or using Gap with its default parameters as provided in GCG Version 6.1.

A reference to a nucleic acid sequence encompasses its complement unless otherwise specified. Thus, a reference to a nucleic acid molecule having a particular sequence should be understood to encompass its complementary strand, with its complementary sequence. The complementary strand is also useful, e.g., for antisense therapy, double stranded RNA (dsRNA) inhibition (RNAi), combination of triplex and antisense, hybridization probes and PCR primers.

In the molecular biology art, researchers use the terms "percent sequence identity", "percent sequence similarity" and "percent sequence homology" interchangeably. In this application, these terms shall have the same meaning with respect to nucleic acid sequences only.

The term "substantial similarity" or "substantial sequence similarity," when referring to a nucleic acid or fragment thereof, indicates that, when optimally aligned with appropriate nucleotide insertions or deletions with another nucleic acid (or its complementary strand), there is nucleotide sequence identity in at least about 50%, more preferably 60% of the nucleotide bases, usually at least about 70%, more usually at least about 80%, preferably at least about 90%, and more preferably at least about 95-98% of the nucleotide bases, as measured by any well known algorithm of sequence identity, such as FASTA, BLAST or Gap, as discussed above.

Alternatively, substantial similarity exists between a first and second nucleic acid sequence when the first nucleic acid sequence or fragment thereof hybridizes to an antisense strand of the second nucleic acid, under selective hybridization conditions. Typically, selective hybridization will occur between the first nucleic acid sequence and an antisense strand of the second nucleic acid sequence when there is at least about 55% sequence identity between the first and second nucleic acid sequences—preferably at least about 65%, more preferably at least about 75%, and most preferably at least about 90%—over a stretch of at least about 14 nucleotides, more preferably at least 17 nucleotides, even more preferably at least 20, 25, 30, 35, 40, 50, 60, 70, 80, 90 or 100 nucleotides.

Nucleic acid hybridization will be affected by such conditions as salt concentration, temperature, solvents, the base composition of the hybridizing species, length of the complementary regions, and the number of nucleotide base mismatches between the hybridizing nucleic acids, as will be readily appreciated by those skilled in the art. "Stringent hybridization conditions" and "stringent wash conditions" in the context of nucleic acid hybridization experiments depend upon a number of different physical parameters. The most important parameters include temperature of hybridization, base composition of the nucleic acids, salt concentration and length of the nucleic acid. One having ordinary skill in the art knows how to vary these parameters to achieve a particular stringency of hybridization. In general, "stringent hybridization" is performed at about 25° C. below the thermal melting point ($T_m$) for the specific DNA hybrid under a particular set of conditions. "Stringent washing" is performed at temperatures about 5° C. lower than the $T_m$ for the specific DNA hybrid under a particular set of conditions. The $T_m$ is the temperature at which 50% of the target sequence hybridizes to a perfectly matched probe. See Sambrook (1989), supra, p. 9.51.

The $T_m$ for a particular DNA-DNA hybrid can be estimated by the formula:

$$T_m = 81.5° C. + 16.6 (\log_{10}[Na^+]) + 0.41 \text{ (fraction } G+C) - 0.63 \text{ (\% formamide)} - (600/l)$$
where l is the length of the hybrid in base pairs.

The $T_m$ for a particular RNA-RNA hybrid can be estimated by the formula:

$$T_m = 79.8° C. + 18.5 (\log_{10}[Na^+]) + 0.58 \text{ (fraction } G+C) + 11.8 \text{ (fraction } G+C)^2 - 0.35 \text{ (\% formamide)} - (820/l).$$

The $T_m$ for a particular RNA-DNA hybrid can be estimated by the formula:

$$T_m = 79.8° C. + 18.5 (\log_{10}[Na^+]) + 0.58 \text{ (fraction } G+C) + 11.8 \text{ (fraction } G+C)^2 - 0.50 \text{ (\% formamide)} - (820/l).$$

In general, the $T_m$ decreases by 1-1.5° C. for each 1% of mismatch between two nucleic acid sequences. Thus, one having ordinary skill in the art can alter hybridization and/or washing conditions to obtain sequences that have higher or lower degrees of sequence identity to the target nucleic acid. For instance, to obtain hybridizing nucleic acids that contain up to 10% mismatch from the target nucleic acid sequence, 10-15° C. would be subtracted from the calculated $T_m$ of a perfectly matched hybrid, and then the hybridization and washing temperatures adjusted accordingly. Probe sequences may also hybridize specifically to duplex DNA under certain conditions to form triplex or other higher order DNA complexes. The preparation of such probes and suitable hybridization conditions are well known in the art.

An example of stringent hybridization conditions for hybridization of complementary nucleic acid sequences having more than 100 complementary residues on a filter in a Southern or Northern blot or for screening a library is 50% formamide/6×SSC at 42° C. for at least ten hours and preferably overnight (approximately 16 hours). Another example of stringent hybridization conditions is 6×SSC at 68° C. without formamide for at least ten hours and preferably overnight. An example of moderate stringency hybridization conditions is 6×SSC at 55° C. without formamide for at least ten hours and preferably overnight. An example of low stringency hybridization conditions for hybridization of complementary nucleic acid sequences having more than 100 complementary residues on a filter in a Southern or northern blot or for screening a library is 6×SSC at 42° C. for at least ten hours. Hybridization conditions to identify nucleic acid sequences that are similar but not identical can be identified by experimentally changing the hybridization temperature from 68° C. to 42° C. while keeping the salt concentration constant (6×SSC), or keeping the hybridization temperature and salt concentration constant (e.g. 42° C. and 6×SSC) and varying the formamide concentration from 50% to 0%. Hybridization buffers may also include blocking agents to lower background. These agents are well-known in the art. See Sambrook et al. (1989), supra, pages 8.46 and 9.46-9.58. See also Ausubel (1992), supra, Ausubel (1999), supra, and Sambrook (2001), supra.

Wash conditions also can be altered to change stringency conditions. An example of stringent wash conditions is a 0.2×SSC wash at 65° C. for 15 minutes (see Sambrook (1989), supra, for SSC buffer). Often the high stringency wash is preceded by a low stringency wash to remove excess probe. An exemplary medium stringency wash for duplex DNA of more than 100 base pairs is 1×SSC at 45° C. for 15 minutes. An exemplary low stringency wash for such a duplex is 4×SSC at 40° C. for 15 minutes. In general, signal-to-noise ratio of 2× or higher than that observed for an unrelated probe in the particular hybridization assay indicates detection of a specific hybridization.

As defined herein, nucleic acids that do not hybridize to each other under stringent conditions are still substantially similar to one another if they encode polypeptides that are substantially identical to each other. This occurs, for example, when a nucleic acid is created synthetically or recombinantly using a high codon degeneracy as permitted by the redundancy of the genetic code.

Hybridization conditions for nucleic acid molecules that are shorter than 100 nucleotides in length (e.g., for oligonucleotide probes) may be calculated by the formula:
$$T_m = 81.5° \quad C. + 16.6(\log_{10}[Na^+]) + 0.41(\text{fraction} \quad G+C) - (600/N),$$
wherein N is change length and the [Na$^+$] is 1 M or less. See Sambrook (1989), supra, p. 11.46. For hybridization of probes shorter than 100 nucleotides, hybridization is usually performed under stringent conditions (5-10° C. below the $T_m$) using high concentrations (0.1-1.0 pmol/ml) of probe. Id. at p. 11.45. Determination of hybridization using mismatched probes, pools of degenerate probes or "guessmers," as well as hybridization solutions and methods for empirically determining hybridization conditions are well known in the art. See, e.g., Ausubel (1999), supra; Sambrook (1989), supra, pp. 11.45-11.57.

The term "digestion" or "digestion of DNA" refers to catalytic cleavage of the DNA with a restriction enzyme that acts only at certain sequences in the DNA. The various restriction enzymes referred to herein are commercially available and their reaction conditions, cofactors and other requirements for use are known and routine to the skilled artisan. For analytical purposes, typically, 1 µg of plasmid or DNA fragment is digested with about 2 units of enzyme in about 20 µl of reaction buffer. For the purpose of isolating DNA fragments for plasmid construction, typically 5 to 50 µg of DNA are digested with 20 to 250 units of enzyme in proportionately larger volumes. Appropriate buffers and substrate amounts for particular restriction enzymes are described in standard laboratory manuals, such as those referenced below, and are specified by commercial suppliers. Incubation times of about 1 hour at 37° C. are ordinarily used, but conditions may vary in accordance with standard procedures, the supplier's instructions and the particulars of the reaction. After digestion, reactions may be analyzed, and fragments may be purified by electrophoresis through an agarose or polyacrylamide gel, using well known methods that are routine for those skilled in the art.

The term "ligation" refers to the process of forming phosphodiester bonds between two or more polynucleotides, which most often are double-stranded DNAs. Techniques for ligation are well known to the art and protocols for ligation are described in standard laboratory manuals and references, such as, e.g., Sambrook (1989), supra.

Genome-derived "single exon probes," are probes that comprise at least part of an exon ("reference exon") and can hybridize detectably under high stringency conditions to transcript-derived nucleic acids that include the reference exon but do not hybridize detectably under high stringency conditions to nucleic acids that lack the reference exon. Single exon probes typically further comprise, contiguous to a first end of the exon portion, a first intronic and/or intergenic sequence that is identically contiguous to the exon in the genome, and may contain a second intronic and/or intergenic sequence that is identically contiguous to the exon in the genome. The minimum length of genome-derived single exon probes is defined by the requirement that the exonic portion be of sufficient length to hybridize under high stringency conditions to transcript-derived nucleic acids, as discussed above. The maximum length of genome-derived single exon probes is defined by the requirement that the probes contain portions of no more than one exon. The single exon probes may contain priming sequences not found in contiguity with the rest of the probe sequence in the genome, which priming sequences are useful for PCR and other amplification-based technologies. In another aspect, the invention is directed to single exon probes based on the OSNAs disclosed herein.

In one embodiment, the term "microarray" refers to a "nucleic acid microarray" having a substrate-bound plurality of nucleic acids, hybridization to each of the plurality of bound nucleic acids being separately detectable. The substrate can be solid or porous, planar or non-planar, unitary or distributed. Nucleic acid microarrays include all the devices so called in Schena (ed.), *DNA Microarrays: A Practical Approach* (*Practical Approach Series*), Oxford University Press (1999); *Nature Genet.* 21(1)(suppl.):1-60 (1999); Schena (ed.), *Microarray Biochip: Tools and Technology*, Eaton Publishing Company/BioTechniques Books Division (2000). Additionally, these nucleic acid microarrays include substrate-bound plurality of nucleic acids in which the plurality of nucleic acids are disposed on a plurality of beads, rather than on a unitary planar substrate, as is described, inter alia, in Brenner et al., *Proc. Natl. Acad. Sci. USA* 97(4):1665-1670 (2000). Examples of nucleic acid microarrays may be found in U.S. Pat. Nos. 6,391,623, 6,383,754, 6,383,749, 6,380,377, 6,379,897, 6,376,191, 6,372,431, 6,351,712 6,344,316, 6,316,193, 6,312,906, 6,309,828, 6,309,824, 6,306,643, 6,300,063, 6,287,850, 6,284,497, 6,284,465, 6,280,954, 6,262,216, 6,251,601, 6,245,518, 6,263,287, 6,251,601, 6,238,866, 6,228,575, 6,214,587, 6,203,989, 6,171,797, 6,103,474, 6,083,726, 6,054,274, 6,040,138, 6,083,726, 6,004,755, 6,001,309, 5,958,342, 5,952,180, 5,936,731, 5,843,655, 5,814,454, 5,837,196, 5,436,327, 5,412,087, 5,405,783, the disclosures of which are incorporated herein by reference in their entireties.

In an alternative embodiment, a "microarray" may also refer to a "peptide microarray" or "protein microarray" having a substrate-bound collection of plurality of polypeptides, the binding to each of the plurality of bound polypeptides being separately detectable. Alternatively, the peptide microarray, may have a plurality of binders, including but not limited to monoclonal antibodies, polyclonal antibodies, phage display binders, yeast 2 hybrid binders, aptamers, which can specifically detect the binding of the polypeptides of this invention. The array may be based on autoantibody detection to the polypeptides of this invention, see Robinson et al., *Nature Medicine* 8(3):295-301 (2002). Examples of peptide arrays may be found in WO 02/31463, WO 02/25288, WO 01/94946, WO 01/88162, WO 01/68671, WO 01/57259, WO 00/61806, WO 00/54046, WO 00/47774, WO 99/40434, WO 99/39210, WO 97/42507 and U.S. Pat. Nos. 6,268,210, 5,766,960, 5,143,854, the disclosures of which are incorporated herein by reference in their entireties.

In addition, determination of the levels of the OSNA or OSP may be made in a multiplex manner using techniques described in WO 02/29109, WO 02/24959, WO 01/83502, WO01/73113, WO 01/59432, WO 01/57269, WO 99/67641, the disclosures of which are incorporated herein by reference in their entireties.

The term "mutant", "mutated", or "mutation" when applied to nucleic acid sequences means that nucleotides in a nucleic acid sequence may be inserted, deleted or changed compared to a reference nucleic acid sequence. A single alteration may be made at a locus (a point mutation) or multiple nucleotides may be inserted, deleted or changed at a single locus. In addition, one or more alterations may be made at any number of loci within a nucleic acid sequence. In a preferred embodiment of the present invention, the nucleic acid sequence is the wild type nucleic acid sequence encoding a OSP or is a OSNA. The nucleic acid sequence may be mutated by any method known in the art including those mutagenesis techniques described infra.

The term "error-prone PCR" refers to a process for performing PCR under conditions where the copying fidelity of the DNA polymerase is low, such that a high rate of point mutations is obtained along the entire length of the PCR product. See, e.g., Leung et al., *Technique* 1: 11-15 (1989) and Caldwell et al., *PCR Methods Applic.* 2: 28-33 (1992).

The term "oligonucleotide-directed mutagenesis" refers to a process which enables the generation of site-specific mutations in any cloned DNA segment of interest. See, e.g. Reidhaar-Olson et al., *Science* 241: 53-57 (1988).

The term "assembly PCR" refers to a process which involves the assembly of a PCR product from a mixture of small DNA fragments. A large number of different PCR reactions occur in parallel in the same vial, with the products of one reaction priming the products of another reaction.

The term "sexual PCR mutagenesis" or "DNA shuffling" refers to a method of error-prone PCR coupled with forced homologous recombination between DNA molecules of different but highly related DNA sequence in vitro, caused by random fragmentation of the DNA molecule based on sequence similarity, followed by fixation of the crossover by primer extension in an error-prone PCR reaction. See, e.g. Stemmer, *Proc. Natl. Acad. Sci. U.S.A.* 91:10747-10751 (1994). DNA shuffling can be carried out between several related genes ("Family shuffling").

The term "in vivo mutagenesis" refers to a process of generating random mutations in any cloned DNA of interest which involves the propagation of the DNA in a strain of bacteria such as *E. coli* that carries mutations in one or more of the DNA repair pathways These "mutator" strains have a higher random mutation rate than that of a wild-type parent Propagating the DNA in a mutator strain will eventually generate random mutations within the DNA.

The term "cassette mutagenesis" refers to any process for replacing a small region of a double-stranded DNA molecule with a synthetic oligonucleotide "cassette" that differs from the native sequence. The oligonucleotide often contains completely and/or partially randomized native sequence.

The term "recursive ensemble mutagenesis" refers to an algorithm for protein engineering (protein mutagenesis) developed to produce diverse populations of phenotypically related mutants whose members differ in amino acid sequence. This method uses a feedback mechanism to control successive rounds of combinatorial cassette mutagenesis. See, e.g., Arkin et al., *Proc. Natl. Acad. Sci. U.S.A.* 89: 7811-7815 (1992).

The term "exponential ensemble mutagenesis" refers to a process for generating combinatorial libraries with a high percentage of unique and functional mutants, wherein small groups of residues are randomized in parallel to identify, at each altered position, amino acids which lead to functional proteins. See, e.g., Delegrave et al., *Biotechnology Research* 11:1548-1552 (1993); Arnold, Current Opinion in Biotechnology 4: 450-455 (1993).

"Operatively linked" expression control sequences refers to a linkage in which the expression control sequence is either contiguous with the gene of interest to control the gene of interest, or acts in trans or at a distance to control the gene of interest.

The term "expression control sequence" as used herein refers to polynucleotide sequences which are necessary to affect the expression of coding sequences to which they are operatively linked. Expression control sequences are sequences Which control the transcription, post-transcriptional events and translation of nucleic acid sequences. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (e.g., ribosome binding sites); sequences that enhance protein stability; and when desired, sequences that enhance protein secretion. The nature of such control sequences differs depending upon the host organism; in prokaryotes, such control sequences generally include promoter, ribosomal binding site, and transcription termination sequence. The term "control sequences" is intended to include, at a minimum, all components whose presence is essential for expression, and can also include additional components whose presence is advantageous, for example, leader sequences and fusion partner sequences.

The term "vector," as used herein, is intended to refer to a nucleic acid molecule capable of transporting another nucleic acid to which it has been linked. One type of vector is a "plasmid", which refers to a circular double stranded DNA loop into which additional DNA segments may be ligated. Other vectors include cosmids, bacterial artificial chromosomes (BAC) and yeast artificial chromosomes (YAC). Another type of vector is a viral vector, wherein additional DNA segments may be ligated into the viral genome. Viral vectors that infect bacterial cells are referred to as bacteriophages. Certain vectors are capable of autonomous replication in a host cell into which they are introduced (e.g., bacterial vectors having a bacterial origin of replication). Other vectors can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" (or simply, "expression vectors"). In general, expression vectors of utility in recombinant DNA techniques are often in the form of plasmids. In the present specification, "plasmid" and "vector" may be used interchangeably as the plasmid is the most commonly used form of vector. However, the invention is intended to include other forms of expression vectors that serve equivalent functions.

The term "recombinant host cell" (or simply "host cell"), as used herein, is intended to refer to a cell into which a recombinant expression vector has been introduced. It should be understood that such terms are intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "host cell" as used herein.

As used herein, the phrase "open reading frame" and the equivalent acronym "ORF" refers to that portion of a transcript-derived nucleic acid that can be translated in its entirety into a sequence of contiguous amino acids. As so defined, an ORF has length, measured in nucleotides, exactly divisible by 3. As so defined, an ORF need not encode the entirety of a natural protein.

As used herein, the phrase "ORF-encoded peptide" refers to the predicted or actual translation of an ORF.

As used herein, the phrase "degenerate variant" of a reference nucleic acid sequence is meant to be inclusive of all nucleic acid sequences that can be directly translated, using the standard genetic code, to provide an amino acid sequence identical to that translated from the reference nucleic acid sequence.

The term "polypeptide" encompasses both naturally occurring and non-naturally occurring proteins and polypeptides, as well as polypeptide fragments and polypeptide mutants, derivatives and analogs thereof. A polypeptide may be monomeric or polymeric. Further, a polypeptide may comprise a number of different modules within a single polypeptide each of which has one or more distinct activities. A preferred polypeptide in accordance with the invention comprises a OSP encoded by a nucleic acid molecule of the instant invention, or a fragment, mutant, analog and derivative thereof.

The term "isolated protein" or "isolated polypeptide" is a protein or polypeptide that by virtue of its origin or source of derivation (1) is not associated with naturally associated components that accompany it in its native state, (2) is free of other proteins from the same species (3) is expressed by a cell from a different species, or (4) does not occur in nature. Thus, a polypeptide that is chemically synthesized or synthesized in a cellular system different from the cell from which it naturally originates will be "isolated" from its naturally associated components. A polypeptide or protein may also be rendered substantially free of naturally associated components by isolation, using protein purification techniques well known in the art.

A protein or polypeptide is "substantially pure," "substantially homogeneous" or "substantially purified" when at least about 60% to 75% of a sample exhibits a single species of polypeptide. The polypeptide or protein may be monomeric or multimeric. A substantially pure polypeptide or protein will typically comprise about 50%, 60%, 70%, 80% or 90% W/W of a protein sample, more usually about 95%, and preferably will be over 99% pure. Protein purity or homogeneity may be determined by a number of means well known in the art, such as polyacrylamide gel electrophoresis of a protein sample, followed by visualizing a single polypeptide band upon staining the gel with a stain well known in the art. For certain purposes, higher resolution may be provided by using HPLC or other means well known in the art for purification.

The term "fragment" when used herein with respect to polypeptides of the present invention refers to a polypeptide that has an amino-terminal and/or carboxy-terminal deletion compared to a full-length OSP. In a preferred embodiment, the fragment is a contiguous sequence in which the amino acid sequence of the fragment is identical to the corresponding positions in the naturally occurring polypeptide. Fragments typically are at least 5, 6, 7, 8, 9 or 10 amino acids long, preferably at least 12, 14, 16 or 18 amino acids long, more preferably at least 20 amino acids long, more preferably at least 25, 30, 35, 40 or 45, amino acids, even more preferably at least 50 or 60 amino acids long, and even more preferably at least 70 amino acids long.

A "derivative" when used herein with respect to polypeptides of the present invention refers to a polypeptide which is substantially similar in primary structural sequence to a OSP but which include, e.g., in vivo or in vitro chemical and biochemical modifications that are not found in the OSP. Such modifications include, for example, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cystine, formation of pyroglutamate, formylation, gamma-carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination. Other modification include, e.g., labeling with radionuclides, and various enzymatic modifications, as will be readily appreciated by those skilled in the art. A variety of methods for labeling polypeptides and of substituents or labels useful for such purposes are well known in the art, and include radioactive isotopes such as $^{125}I$, $^{32}P$, $^{35}S$, $^{14}C$ and $^3H$, ligands which bind to labeled antiligands (e.g., antibodies), fluorophores, chemiluminescent agents, enzymes, and antiligands which can serve as specific binding pair members for a labeled ligand. The choice of label depends on the sensitivity required, ease of conjugation with the primer, stability requirements, and available instrumentation. Methods for labeling polypeptides are well known in the art. See Ausubel (1992), supra; Ausubel (1999), supra.

The term "fusion protein" refers to polypeptides of the present invention coupled to a heterologous amino acid sequences. Fusion proteins are useful because they can be constructed to contain two or more desired functional elements from two or more different proteins. A fusion protein comprises at least 10 contiguous amino acids from a polypeptide of interest, more preferably at least 20 or 30 amino acids, even more preferably at least 40, 50 or 60 amino acids, yet more preferably at least 75, 100 or 125 amino acids. Fusion proteins can be produced recombinantly by constructing a nucleic acid sequence that encodes the polypeptide or a fragment thereof in frame with a nucleic acid sequence encoding a different protein or peptide and then expressing the fusion protein. Alternatively, a fusion protein can be produced chemically by crosslinking the polypeptide or a fragment thereof to another protein.

The term "analog" refers to both polypeptide analogs and non-peptide analogs. The term "polypeptide analog" as used herein refers to a polypeptide that is comprised of a segment of at least 25 amino acids that has substantial identity to a portion of an amino acid sequence but which contains non-natural amino acids or non-natural inter-residue bonds. In a preferred embodiment, the analog has the same or similar biological activity as the native polypeptide. Typically, polypeptide analogs comprise a conservative amino acid substitution (or insertion or deletion) with respect to the naturally occurring sequence. Analogs typically are at least 20 amino acids long, preferably at least 50 amino acids long or longer, and can often be as long as a full-length naturally occurring polypeptide.

The term "non-peptide analog" refers to a compound with properties that are analogous to those of a reference polypeptide. A non-peptide compound may also be termed a "peptide mimetic" or a "peptidomimetic." Such compounds are often developed with the aid of computerized molecular modeling. Peptide mimetics that are structurally similar to useful peptides may be used to produce an equivalent effect. Generally, peptidomimetics are structurally similar to a paradigm polypeptide (i.e., a polypeptide that has a desired biochemical property or pharmacological activity), but have one or more peptide linkages optionally replaced by a linkage selected from the group consisting of: —$CH_2NH$—, —$CH_2S$—, —$CH_2$—$CH_2$—, —CH=CH-(cis and trans), —$OCH_2$—, —$H(OH)CH_2$—, and —$CH_2SO$—, by methods well known in the art. Systematic substitution of one or more amino acids of a consensus sequence with a D-amino acid of the same type (e.g., D-lysine in place of L-lysine) may also be used to generate more stable peptides. In addition, constrained peptides comprising a consensus sequence or a substantially identical consensus sequence variation may be generated by methods known in the art (Rizzo et al., Ann. Rev. Biochem. 61:387418 (1992)). For example, one may add internal cysteine residues capable of forming intramolecular disulfide bridges which cyclize the peptide.

The term "mutant" or "mutein" when referring to a polypeptide of the present invention relates to an amino acid sequence containing substitutions, insertions or deletions of one or more amino acids compared to the amino acid sequence of a OSP. A mutein may have one or more amino acid point substitutions, in which a single amino acid at a position has been changed to another amino acid, one or more insertions and/or deletions, in which one or more amino acids are inserted or deleted, respectively, in the sequence of the naturally occurring protein, and/or truncations of the amino acid sequence at either or both the amino or carboxy termini. Further, a mutein may have the same or different biological activity as the naturally occurring protein. For instance, a mutein may have an increased or decreased biological activity. A mutein has at least 50% sequence similarity to the wild type protein, preferred is 60% sequence similarity, more preferred is 70% sequence similarity. Even more preferred are muteins having 80%, 85% or 90% sequence similarity to a OSP. In an even more preferred embodiment, a mutein exhibits 95% sequence identity, even more preferably 97%, even more preferably 98% and even more preferably 99%. Sequence similarity may be measured by any common sequence analysis algorithm, such as GAP or BESTFIT or other variation Smith-Waterman alignment. See, T. F. Smith and M. S. Waterman, J. Mol. Biol. 147:195-197 (1981) and W. R. Pearson, Genomics 11:635-650 (1991).

Preferred amino acid substitutions are those which: (1) reduce susceptibility to proteolysis, (2) reduce susceptibility to oxidation, (3) alter binding affinity for forming protein complexes, (4) alter binding affinity or enzymatic activity, and (5) confer or modify other physicochemical or functional properties of such analogs. For example, single or multiple amino acid substitutions (preferably conservative amino acid substitutions) may be made in the naturally occurring sequence (preferably in the portion of the polypeptide outside the domain(s) forming intermolecular contacts. In a preferred embodiment, the amino acid substitutions are moderately conservative substitutions or conservative substitutions. In a more preferred embodiment, the amino acid substitutions are conservative substitutions. A conservative amino acid substitution should not substantially change the structural characteristics of the parent sequence (e.g., a replacement amino acid should not tend to disrupt a helix that occurs in the parent sequence, or disrupt other types of secondary structure that characterizes the parent sequence). Examples of art-recognized polypeptide secondary and tertiary structures are described in Creighton (ed.), *Proteins, Structures and Molecular Principles*, W. H. Freeman and Company (1984); Branden et al. (ed.), *Introduction to Protein Structure*, Garland Publishing (1991); Thornton et al., *Nature* 354:105-106 (1991).

As used herein, the twenty conventional amino acids and their abbreviations follow conventional usage. See Golub et al. (eds.), *Immunology—A Synthesis* $2^{nd}$ Ed., Sinauer Associates (1991). Stereoisomers (e.g., D-amino acids) of the twenty conventional amino acids, unnatural amino acids such as α-,α-disubstituted amino acids, N-alkyl amino acids, and other unconventional amino acids may also be suitable components for polypeptides of the present invention. Examples of unconventional amino acids include: 4-hydroxyproline, γ-carboxyglutamate, ε-N,N,N-trimethyllysine, ε-N-acetyllysine, O-phosphoserine, N-acetylserine, N-formylmethionine, 3-methylhistidine, 5-hydroxylysine, s-N-methylarginine, and other similar amino acids and imino acids (e.g., 4-hydroxyproline). In the polypeptide notation used herein, the lefthand direction is the amino terminal direction and the right hand direction is the carboxy-terminal direction, in accordance with standard usage and convention.

By "homology" or "homologous" when referring to a polypeptide of the present invention it is meant polypeptides from different organisms with a similar sequence to the encoded amino acid sequence of a OSP and a similar biological activity or function. Although two polypeptides are said to be "homologous," this does not imply that there is necessarily an evolutionary relationship between the polypeptides. Instead, the term "homologous" is defined to mean that the two polypeptides have similar amino acid sequences and similar biological activities or functions. In a preferred embodiment, a homologous polypeptide is one that exhibits 50% sequence similarity to OSP, preferred is 60% sequence similarity, more preferred is 70% sequence similarity. Even more preferred are homologous polypeptides that exhibit 80%, 85% or 90% sequence similarity to a OSP. In a yet more preferred embodiment, a homologous polypeptide exhibits 95%, 97%, 98% or 99% sequence similarity.

When "sequence similarity" is used in reference to polypeptides, it is recognized that residue positions that are not identical often differ by conservative amino acid substitutions. In a preferred embodiment, a polypeptide that has "sequence similarity" comprises conservative or moderately conservative amino acid substitutions. A "conservative amino acid substitution" is one in which an amino acid residue is substituted by another amino acid residue having a side chain R group) with similar chemical properties (e.g., charge or hydrophobicity). In general, a conservative amino acid substitution will not substantially change the functional properties of a protein. In cases where two or more amino acid sequences differ from each other by conservative substitutions, the percent sequence identity or degree of similarity may be adjusted upwards to correct for the conservative nature of the substitution. Means for making this adjustment are well known to those of skill in the art. See, e.g. Pearson, *Methods Mol. Biol.* 24: 307-31 (1994).

For instance, the following six groups each contain amino acids that are conservative substitutions for one another:
1) Serine (S), Threonine (T);
2) Aspartic Acid (D), Glutamic Acid (E);
3) Asparagine (N), Glutamine (Q);
4) Arginine (R), Lysine (K);
5) Isoleucine (I), Leucine (L), Methionine (M), Alanine (A), Valine (V), and
6) Phenylalanine (F), Tyrosine (Y), Tryptophan (W).

Alternatively, a conservative replacement is any change having a positive value in the PAM250 log-likelihood matrix disclosed in Gonnet et al., *Science* 256:1443-45 (1992). A "moderately conservative" replacement is any change having a nonnegative value in the PAM250 log-likelihood matrix.

Sequence similarity for polypeptides, which is also referred to as sequence identity, is typically measured using sequence analysis software. Protein analysis software matches similar sequences using measures of similarity assigned to various substitutions, deletions and other modifications, including conservative amino acid substitutions. For instance, GCG contains programs such as "Gap" and "Bestfit" which can be used with default parameters to determine sequence homology or sequence identity between closely related polypeptides, such as homologous polypeptides from different species of organisms or between a wild type protein and a mutein thereof. See, e.g., GCG Version 6.1. Other programs include FASTA, discussed supra.

A preferred algorithm when comparing a sequence of the invention to a database containing a large number of sequences from different organisms is the computer program BLAST, especially blastp or tblastn. See, e.g., Altschul et al., *J. Mol. Biol.* 215: 403410 (1990); Altschul et al., *Nucleic Acids Res.* 25:3389402 (1997). Preferred parameters for blastp are:
Expectation value: 10 (default)
Filter: seg (default)
Cost to open a gap: 11 (default)
Cost to extend a gap: 1 (default
Max. alignments: 100 (default)
Word size: 11 (default)
No. of descriptions: 100 (default)
Penalty Matrix: BLOSUM62

The length of polypeptide sequences compared for homology will generally be at least about 16 amino acid residues, usually at least about 20 residues, more usually at least about 24 residues, typically at least about 28 residues, and preferably more than about 35 residues. When searching a database containing sequences from a large number of different organisms, it is preferable to compare amino acid sequences.

Algorithms other than blastp for database searching using amino acid sequences are known in the art. For instance, polypeptide sequences can be compared using FASTA, a program in GCG Version 6.1. FASTA (e.g., FASTA2 and FASTA3) provides alignments and percent sequence identity of the regions of the best overlap between the query and search sequences (Pearson (1990), supra; Pearson (2000), supra. For example, percent sequence identity between amino acid sequences can be determined using FASTA with its default or recommended parameters (a word size of 2 and the PAM250 scoring matrix), as provided in GCG Version 6.1.

An "antibody" refers to an intact immunoglobulin, or to an antigen-binding portion thereof that competes with the intact antibody for specific binding to a molecular species, e.g., a polypeptide of the instant invention. Antigen-binding portions may be produced by recombinant DNA techniques or by enzymatic or chemical cleavage of intact antibodies. Antigen-binding portions include, inter alia, Fab, Fab', F(ab')$_2$, Fv, dAb, and complementarity determining region (CDR) fragments, single-chain antibodies (scFv), chimeric antibodies, diabodies and polypeptides that contain at least a portion of an immunoglobulin that is sufficient to confer specific antigen binding to the polypeptide. A Fab fragment is a monovalent fragment consisting of the VL, VH, CL and CH1 domains; a F(ab')$_2$ fragment is a bivalent fragment comprising two Fab fragments linked by a disulfide bridge at the hinge region; a Fd fragment consists of the VH and CH1 domains; a Fv fragment consists of the VL and VH domains of a single arm of an antibody; and a dAb fragment consists of a VH domain. See, e.g., Ward et al., *Nature* 341: 544-546 (1989).

By "bind specifically" and "specific binding" as used herein it is meant the ability of the antibody to bind to a first molecular species in preference to binding to other molecular species with which the antibody and first molecular species are admixed. An antibody is said specifically to "recognize" a first molecular species when it can bind specifically to that first molecular species.

A single-chain antibody (scFv) is an antibody in which VL and VH regions are paired to form a monovalent molecule via a synthetic linker that enables them to be made as a single protein chain. See, e.g., Bird et al., *Science* 242: 423426 (1988); Huston et al., *Proc. Natl. Acad. Sci. USA* 85: 5879-5883 (1988). Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites. See e.g., Holliger et al., *Proc. Natl. Acad. Sci. USA* 90: 644-6448 (1993); Poljak et al., *Structure* 2: 1121-1123 (1994). One or more CDRs may be incorporated into a molecule either covalently or noncovalently to make it an immunoadhesin. An immunoadhesin may incorporate the CDR(s) as part of a larger polypeptide chain, may covalently link the CDR(s) to another polypeptide chain, or may incorporate the CDR(s) noncovalently. The CDRs permit the immunoadhesin to specifically bind to a particular antigen of interest. A chimeric antibody is an antibody that contains one or more regions from one antibody and one or more regions from one or more other antibodies.

An antibody may have one or more binding sites. If there is more than one binding site, the binding sites may be identical to one another or may be different. For instance, a naturally occurring immunoglobulin has two identical binding sites, a single-chain antibody or Fab fragment has one binding site, while a "bispecific" or "bifunctional" antibody has two different binding sites.

An "isolated antibody" is an antibody that (1) is not associated with naturally-associated components, including other naturally-associated antibodies, that accompany it in its native state, (2) is free of other proteins from the same species, (3) is expressed by a cell from a different species, or (4) does not occur in nature. It is known that purified proteins, including purified antibodies, may be stabilized with non-naturally-associated components. The non-naturally-associated component may be a protein, such as albumin (e.g., BSA) or a chemical such as polyethylene glycol (PEG).

A "neutralizing antibody" or "an inhibitory antibody" is an antibody that inhibits the activity of a polypeptide or blocks the binding of a polypeptide to a ligand that normally binds to it. An "activating antibody" is an antibody that increases the activity of a polypeptide.

The term "epitope" includes any protein determinant capable of specific binding to an immunoglobulin or T-cell receptor. Epitopic determinants usually consist of chemically active surface groupings of molecules such as amino acids or sugar side chains and usually have specific three-dimensional structural characteristics, as well as specific charge characteristics. An antibody is said to specifically bind an antigen when the dissociation constant is less than 1 μM, preferably less than 100 nM and most preferably less than 10 nM.

The term "patient" includes human and veterinary subjects.

Throughout this specification and claims, the word "comprise," or variations such as "comprises" or "comprising," will be understood to imply the inclusion of a stated integer or group of integers but not the exclusion of any other integer or group of integers.

The term "ovarian specific" refers to a nucleic acid molecule or polypeptide that is expressed predominantly in the ovarian as compared to other tissues in the body. In a preferred embodiment, a "ovarian specific" nucleic acid molecule or polypeptide is detected at a level that is 1.5-fold higher than any other tissue in the body. In a more preferred embodiment, the "ovarian specific" nucleic acid molecule or polypeptide is detected at a level that is 2-fold higher than any other tissue in the body, more preferably 5-fold higher, still more preferably at least 10-fold, 15-fold, 20-fold, 25-fold, 50-fold or 100-fold higher than any other tissue in the body. Nucleic acid molecule levels may be measured by nucleic acid hybridization, such as Northern blot hybridization, or quantitative PCR. Polypeptide levels may be measured by any method known to accurately quantitate protein levels, such as Western blot analysis.

Nucleic Acid Molecules, Regulatory Sequences, Vectors, Host Cells and Recombinant Methods of Making Polypeptides Nucleic Acid Molecules One aspect of the invention provides isolated nucleic acid molecules that are specific to the ovarian or to ovarian cells or tissue or that are derived from such nucleic acid molecules. These isolated ovarian specific nucleic acids (OSNAs) may comprise cDNA genomic DNA, RNA, or a combination thereof, a fragment of one of these nucleic acids, or may be a non-naturally occurring nucleic acid molecule. A OSNA may be derived from an animal. In a preferred embodiment, the OSNA is derived from a human or other mammal. In a more preferred embodiment, the OSNA is derived from a human or other primate. In an even more preferred embodiment, the OSNA is derived from a human.

In a preferred embodiment, the nucleic acid molecule encodes a polypeptide that is specific to ovarian, a ovarian-specific polypeptide (OSP). In a more preferred embodiment, the nucleic acid molecule encodes a polypeptide that comprises an amino acid sequence of SEQ ID NO: 249-396. In another highly preferred embodiment, the nucleic acid molecule comprises a nucleic acid sequence of SEQ ID NO: 1-248. Nucleotide sequences of the instantly-described nucleic acid molecules were determined by assembling several DNA molecules from either public or proprietary databases. Some of the underlying DNA sequences are the result, directly or indirectly, of at least one enzymatic polymerization reaction (e.g., reverse transcription and/or polymerase chain reaction) using an automated sequencer (such as the MegaBACE™ 1000, Amersham Biosciences, Sunnyvale, Calif., USA).

Nucleic acid molecules of the present invention may also comprise sequences that selectively hybridizes to a nucleic acid molecule encoding a OSNA or a complement or antisense thereof. The hybridizing nucleic acid molecule may or may not encode a polypeptide or may or may not encode a OSP. However, in a preferred embodiment, the hybridizing nucleic acid molecule encodes a OSP. In a more preferred embodiment, the invention provides a nucleic acid molecule that selectively hybridizes to a nucleic acid molecule or the antisense sequence of a nucleic acid molecule that encodes a polypeptide comprising an amino acid sequence of SEQ ID NO: 249-396. In an even more preferred embodiment, the invention provides a nucleic acid molecule that selectively hybridizes to a nucleic acid molecule comprising the nucleic acid sequence of SEQ ID NO: 1-248 or the antisense sequence thereof. Preferably, the nucleic acid molecule selectively hybridizes to a nucleic acid molecule or the antisense sequence of a nucleic acid molecule encoding a OSP under low stringency conditions. More preferably, the nucleic acid molecule selectively hybridizes to a nucleic acid molecule or the antisense sequence of a nucleic acid molecule encoding a OSP under moderate stringency conditions. Most preferably, the nucleic acid molecule selectively hybridizes to a nucleic acid molecule or the antisense sequence of a nucleic acid molecule encoding a OSP under high stringency conditions. In a preferred embodiment, the nucleic acid molecule hybridizes under low, moderate or high stringency conditions to a nucleic acid molecule or the antisense sequence of a nucleic acid molecule encoding a polypeptide comprising an amino acid sequence of SEQ ID NO: 249-396. In a more preferred embodiment, the nucleic acid molecule hybridizes under low, moderate or high stringency conditions to a nucleic acid molecule or the antisense sequence of a nucleic acid molecule comprising a nucleic acid sequence selected from SEQ ID NO: 1-248.

Nucleic acid molecules of the present invention may also comprise nucleic acid sequences that exhibit substantial sequence similarity to a nucleic acid encoding a OSP or a complement of the encoding nucleic acid molecule. In this embodiment, it is preferred that the nucleic acid molecule exhibit substantial sequence similarity to a nucleic acid molecule encoding human OSP. More preferred is a nucleic acid molecule exhibiting substantial sequence similarity to a nucleic acid molecule encoding a polypeptide having an amino acid sequence of SEQ ID NO: 249-396. By substantial sequence similarity it is meant a nucleic acid molecule having at least 60% sequence identity with a nucleic acid molecule encoding a OSP, such as a polypeptide having an amino acid sequence of SEQ ID NO: 249-396, more preferably at least 70%, even more preferably at least 80% and even more preferably at least 85%. In a more preferred embodiment, tire similar nucleic acid molecule is one that has at least 90% sequence identity with a nucleic acid molecule encoding a OSP, more preferably at least 95%, more preferably at least 97%, even more preferably at least 98%, and still more preferably at least 99%. Most preferred in this embodiment is a nucleic acid molecule that has at least 99.5%, 99.6%, 99.7%, 99.8% or 99.9% sequence identity with a nucleic acid molecule encoding a OSP.

The nucleic acid molecules of the present invention are also inclusive of those exhibiting substantial sequence similarity to a OSNA or its complement. In this embodiment, it is preferred that the nucleic acid molecule exhibit substantial sequence similarity to a nucleic acid molecule having a nucleic acid sequence of SEQ ID NO: 1-248. By substantial sequence similarity it is meant a nucleic acid molecule that has at least 60% sequence identity with a OSNA, such as one having a nucleic acid sequence of SEQ ID NO: 1-248, more preferably at least 70%, even more preferably at least 80% and even more preferably at least 85%. More preferred is a nucleic acid molecule that has at least 90% sequence identity with a OSNA, more preferably at least 95%, more preferably at least 97%, even more preferably at least 98%, and still more preferably at least 99%. Most preferred is a nucleic acid molecule that has at least 99.5%, 99.6%, 99.7%, 99.8% or 99.9% sequence identity with a OSNA.

Nucleic acid molecules that exhibit substantial sequence similarity are inclusive of sequences that exhibit sequence identity over their entire length to a OSNA or to a nucleic acid molecule encoding a OSP, as well as sequences that are similar over only a part of its length. In this case, the part is at least 50 nucleotides of the OSNA or the nucleic acid molecule encoding a OSP, preferably at least 100 nucleotides, more preferably at least 150 or 200 nucleotides, even more preferably at least 250 or 300 nucleotides, still more preferably at least 400 or 500 nucleotides.

The substantially similar nucleic acid molecule may be a naturally occurring one that is derived from another species, especially one derived from another primate, wherein the similar nucleic acid molecule encodes an amino acid sequence that exhibits significant sequence identity to that of SEQ ID NO: 249-396 or demonstrates significant sequence identity to the nucleotide sequence of SEQ ID NO: 1-248. The similar nucleic acid molecule may also be a naturally occurring nucleic acid molecule from a human, when the OSNA is a member of a gene family. The similar nucleic acid molecule may also be a naturally occurring nucleic acid molecule derived from a non-primate, mammalian species, including without limitation, domesticated species, e.g., dog, cat, mouse, rat, rabbit, hamster, cow, horse and pig; and wild animals, e.g., monkey, fox, lions, tigers, bears, giraffes, zebras, etc. The substantially similar nucleic acid molecule may also be a naturally occurring nucleic acid molecule derived from a non-mammalian species, such as birds or reptiles. The naturally occurring substantially similar nucleic acid molecule may be isolated directly from humans or other species. In another embodiment, the substantially similar nucleic acid molecule may be one that is experimentally produced by random mutation of a nucleic acid molecule. In another embodiment, the substantially similar nucleic acid molecule may be one that is experimentally produced by directed mutation of a OSNA. In a preferred embodiment, the substantially similar nucleic acid molecule is an OSNA.

The nucleic acid molecules of the present invention are also inclusive of allelic variants of a OSNA or a nucleic acid encoding a OSP. For example, single nucleotide polymorphisms (SNPs) occur frequently in eukaryotic genomes and the sequence determined from one individual of a species may differ from other allelic forms present within the population. More than 1.4 million SNPs have already identified in the human genome, International Human Genome Sequencing Consortium, *Nature* 409: 860-921 (2001)—Variants with small deletions and insertions of more than a single nucleotide are also found in the general population, and often do not alter the function of the protein. In addition, amino acid substitutions occur frequently among natural allelic variants, and often do not substantially change protein function.

In a preferred embodiment, the allelic variant is a variant of a gene, wherein the gene is transcribed into an mRNA that encodes a OSP. In a more preferred embodiment, the gene is transcribed into an mRNA that encodes a OSP comprising an amino acid sequence of SEQ ID NO: 249-396. In another preferred embodiment, the allelic variant is a variant of a gene, wherein the gene is transcribed into an mRNA that is a OSNA. In a more preferred embodiment, the gene is transcribed into an mRNA that comprises the nucleic acid sequence of SEQ ID NO: 1-248. Also preferred is that the allelic variant is a naturally occurring allelic variant in the species of interest, particularly human.

Nucleic acid molecules of the present invention are also inclusive of nucleic acid sequences comprising a part of a nucleic acid sequence of the instant invention. The part may or may not encode a polypeptide, and may or may not encode a polypeptide that is a OSP. In a preferred embodiment, the part encodes a OSP. In one embodiment, the nucleic acid molecule comprises a part of a OSNA. In another embodiment, the nucleic acid molecule comprises a part of a nucleic acid molecule that hybridizes or exhibits substantial sequence similarity to a OSNA. In another embodiment, the nucleic acid molecule comprises a part of a nucleic acid molecule that is an allelic variant of a OSNA. In yet another embodiment, the nucleic acid molecule comprises a part of a nucleic acid molecule that encodes a OSP. A part comprises at least 10 nucleotides, more preferably at least 15, 17, 18, 20, 25, 30, 35, 40, 50, 60, 70, 80, 90, 100, 150, 200, 250, 300, 350, 400 or 500 nucleotides. The maximum size of a nucleic acid part is one nucleotide shorter than the sequence of the nucleic acid molecule encoding the full-length protein.

Nucleic acid molecules of the present invention are also inclusive of nucleic acid sequences that encode fusion proteins, homologous proteins, polypeptide fragments, muteins and polypeptide analogs, as described infra.

Nucleic acid molecules of the present invention are also inclusive of nucleic acid sequences containing modifications of the native nucleic acid molecule. Examples of such modifications include, but are not limited to, normative inter-nucleoside bonds, post-synthetic modifications or altered nucleotide analogues. One having ordinary skill in the art would recognize that the type of modification that may be made will depend upon the intended use of the nucleic acid molecule. For instance, when the nucleic acid molecule is used as a hybridization probe, the range of such modifications will be limited to those that permit sequence-discriminating base pairing of the resulting nucleic acid. When used to direct expression of RNA or protein in vitro or in vivo, the range of such modifications will be limited to those that permit the nucleic acid to function properly as a polymerization substrate. When the isolated nucleic acid is used as a therapeutic agent, the modifications will be limited to those that do not confer toxicity upon the isolated nucleic acid.

Accordingly, in one embodiment, a nucleic acid molecule may include nucleotide analogues that incorporate labels that are directly detectable, such as radiolabels or fluorophores, or nucleotide analogues that incorporate labels that can be visualized in a subsequent reaction, such as biotin or various haptens. The labeled nucleic acid molecules are particularly useful as hybridization probes.

Common radiolabeled analogues include those labeled with $^{33}$P, $^{32}$P, and $^{35}$S, such as $\alpha$-$^{32}$P-dATP, $\alpha$-$^{32}$P-dCTP, $\alpha$-$^{32}$P-dGTP, $\alpha$-$^{32}$P-dTTP, $\alpha$-$^{32}$P-3'dATP, $\alpha$-$^{32}$P-ATP, $\alpha$-$^{32}$P-CTP, $\alpha$-$^{32}$P-GTP, $\alpha$-$^{32}$P-UTP, $\alpha$-$^{35}$S-dATP, $\gamma$-$^{35}$S-GTP, $\gamma$-$^{33}$P-dATP, and the like.

Commercially available fluorescent nucleotide analogues readily incorporated into the nucleic acids of the present invention include Cy3-dCTP, Cy3-dUTP, Cy5-dCTP, Cy3-dUTP (Amersham Biosciences, Piscataway, N.J., USA), fluorescein-12-dUTP, tetramethylrhodamine-6-dUTP, Texas Red®-5-dUTP, Cascade Blue®-7-dUTP, BODIPY®L FL-14-dUTP, BODIPY® TMR-14-dUTP, BODIPY® TR-14-dUTP, Rhodamine Green™-5-dUTP, Oregon Green® 488-5-dUTP, Texas Red®-12-dUTP, BODIPY® 630/650-14-dUTP, BODIPY®D 650/665-14-dUTP, Alexa Fluor® 488-5-dUTP, Alexa Fluor® 532-5-dUTP, Alexa Fluor® 568-5-dUTP, Alexa Fluor® 594-5-dUTP, Alexa Fluor® 546-14-dUTP, fluorescein-12-UTP, tetramethylrhodamine-6-UTP, Texas Red®-5-UTP, Cascade Blue®-7-UTP, BODIPY® FL-14-UTP, BODIPY® TMR-14-UTP, BODIPY® TR-14-UTP, Rhodamine Green™-5-UTP, Alexa Fluor® 488-5-UTP, Alexa Fluor® 546-14-UTP (Molecular Probes, Inc. Eugene, Oreg., USA). One may also custom synthesize nucleotides having other fluorophores. See Henegariu et al., *Nature Biotechnol.* 18: 345-348 (2000).

Haptens that are commonly conjugated to nucleotides for subsequent labeling include biotin (biotin-11-dUTP, Molecular Probes, Inc., Eugene, Oreg., USA; biotin-21-UTP, biotin-21-dUTP, Clontech Laboratories, Inc., Palo Alto, Calif., USA), digoxigenin (DIG-11-dUTP, alkali labile, DIG-11-UTP, Roche Diagnostics Corp., Indianapolis, Ind., USA), and dinitrophenyl(dinitrophenyl-11-dUTP, Molecular Probes, Inc., Eugene, Oreg., USA).

Nucleic acid molecules of the present invention can be labeled by incorporation of labeled nucleotide analogues into the nucleic acid. Such analogues can be incorporated by enzymatic polymerization, such as by nick translation, random priming, polymerase chair reaction (PCR), terminal transferase tailing, and end-filling of overhangs, for DNA molecules, and in vitro transcription driven, e.g., from phage promoters, such as T7, T3, and SP6, for RNA molecules. Commercial kits are readily available for each such labeling approach. Analogues can also be incorporated during automated solid phase chemical synthesis. Labels can also be incorporated after nucleic acid synthesis, with the 5' phosphate and 3' hydroxyl providing convenient sites for post-synthetic covalent attachment of detectable labels.

Other post-synthetic approaches also permit internal labeling of nucleic acids. For example, fluorophores can be attached using a cisplatin reagent that reacts with the N7 of guanine residues (and, to a lesser extent, adenine bases) in DNA, RNA, and Peptide Nucleic Acids (PNA) to provide a stable coordination complex between the nucleic acid and fluorophore label (Universal Linkage System) (available from Molecular Probes, Inc., Eugene, Oreg., USA and Amersham Pharmacia Biotech, Piscataway, N.J., USA); see Alers et al., *Genes, Chromosomes & Cancer* 25: 301-305 (1999); Jelsma et al., *J. NIH Res.* 5: 82 (1994); Van Belkum et al., *BioTechniques* 16: 148-153 (1994). Alternatively, nucleic acids can be labeled using a disulfide-containing linker (Fast-Tag™ Reagent, Vector Laboratories, Inc., Burlingame, Calif., USA) that is photo- or thermally coupled to the target nucleic acid using aryl azide chemistry; after reduction, a free thiol is available for coupling to a hapten, fluorophore, sugar, affinity ligand, or other marker.

One or more independent or interacting labels can be incorporated into the nucleic acid molecules of the present invention. For example, both a fluorophore and a moiety that in proximity thereto acts to quench fluorescence can be included to report specific hybridization through release of fluorescence quenching or to report exonucleotidic excision. See, e.g., Tyagi et al., *Nature Biotechnol.* 14: 303-308 (1996); Tyagi et al., *Nature Biotechnol.* 16: 49-53 (1998); Sokol et al., *Proc. Natl. Acad. Sci. USA* 95: 11538-11543 (1998); Kostrikis et al., *Science* 279: 1228-1229 (1998); Marras et al., *Genet. Anal.* 14: 151-156 (1999); Holland et al., *Proc. Natl. Acad. Sci. USA* 88: 7276-7280 (1991); Heid et al., *Genome Res.* 6(10): 986-94 (1996); Kuimelis et al., *Nucleic Acids Symp. Ser.* (37): 255-6 (1997); and U.S. Pat. Nos. 5,846,726, 5,925,517, 5,925,517, 5,723,591 and 5,538,848, the disclosures of which are incorporated herein by reference in their entireties.

Nucleic acid molecules of the present invention may also be modified by altering one or more native phosphodiester internucleoside bonds to more nuclease-resistant, internucleoside bonds. See Hartmann et al. (eds.), *Manual of Antisense Methodology: Perspectives in Antisense Science*, Kluwer Law International (1999); Stein et al. (eds.), *Applied Antisense Oligonucleotide Technology*, Wiley-Liss (1998); Chadwick et al. (eds.), *Oligonucleotides as Therapeutic Agents—Symposium No. 209*, John Wiley & Son Ltd (1997). Such altered internucleoside bonds are often desired for techniques or for targeted gene correction, Gamper et al., *Nucl. Acids Res.* 28(21): 43324339 (2000). For double stranded RNA inhibition which may utilize either natural ds RNA or ds RNA modified in its, sugar, phosphate or base, see Hannon, *Nature* 418(11): 244-251 (2002); Fire et al. in WO 99/32619; Tuschl et al. in US2002/0086356; Kruetzer et al. in WO 00/44895, the disclosures of which are incorporated herein by reference in their entirety. For circular antisense, see Kool in U.S. Pat. No. 5,426,180, the disclosure of which is incorporated herein by reference in its entirety.

Modified oligonucleotide backbones include, without limitation, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Representative U.S. patents that teach the preparation of the above phosphorus-containing linkages include, but are not limited to, U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050, the disclosures of which are incorporated herein by reference in their entireties. In a preferred embodiment, the modified internucleoside linkages may be used for antisense techniques.

Other modified oligonucleotide backbones do not include a phosphorus atom, but have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts. Representative U.S. patents that teach the preparation of the above backbones include, but are not limited to, U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437 and 5,677,439; the disclosures of which are incorporated herein by reference in their entireties.

In other preferred nucleic acid molecules, both the sugar and the internucleoside linkage are replaced with novel groups, such as peptide nucleic acids (PNA). In PNA compounds, the phosphodiester backbone of the nucleic acid is replaced with an amide-containing backbone, in particular by repeating N-(2-aminoethyl)glycine units linked by amide bonds. Nucleobases are bound directly or indirectly to aza nitrogen atoms of the amide portion of the backbone, typically by methylene carbonyl linkages. PNA can be synthesized using a modified peptide synthesis protocol. PNA oligomers can be synthesized by both Fmoc and tBoc methods. Representative U.S. patents that teach the preparation of PNA compounds include, but are not limited to, U.S. Pat. Nos. 5,539,082; 5,714,331; and 5,719,262, each of which is herein incorporated by reference in its entirety. Automated PNA synthesis is readily achievable on commercial synthesizers (see, e.g., "PNA User's Guide," Rev. 2, February 1998, Perseptive Biosystems Part No. 60138, Applied Biosystems, Inc., Foster City, Calif.). PNA molecules are advantageous for a number of reasons. First, because the PNA backbone is uncharged, PNA/DNA and PNA/RNA duplexes have a higher thermal stability than is found in DNA/DNA and DNA/RNA duplexes. The Tm of a PNA/DNA or PNA/RNA duplex is generally 1° C. higher per base pair than the Tm of the corresponding DNA/DNA or DNA/RNA duplex (in 100 mM NaCl). Second, PNA molecules can also form stable PNA/DNA complexes at low ionic strength, under conditions in which DNA/DNA duplex formation does not occur. Third, PNA also demonstrates greater specificity in binding to complementary DNA because a PNA/DNA mismatch is more destabilizing than DNA/DNA mismatch. A single mismatch in mixed a PNA/DNA 15-mer lowers the Tm by 8-20° C. (15° C. on average). In the corresponding DNA/DNA duplexes, a single mismatch lowers the Tm by 4-16° C. (11° C. on average). Because PNA probes can be significantly shorter than DNA probes, their specificity is greater. Fourth, PNA oligomers are resistant to degradation by enzymes, and the lifetime of these compounds is extended both in vivo and in vitro because nucleases and proteases do not recognize the PNA polyamide backbone with nucleobase sidechains. See, e.g., Ray et al., *FASEB J.* 14(9): 1041-60 (2000); Nielsen et al., *Pharmacol Toxicol.* 86(1): 3-7 (2000); Larsen et al., *Biochim Biophys Acta.* 1489(1): 159-66 (1999); Nielsen, *Curr. Opin. Struct. Biol.* 9(3): 353-7 (1999), and Nielsen, *Curr. Opin. Biotechnol.* 10(1): 71-5 (1999).

Nucleic acid molecules may be modified compared to their native structure throughout the length of the nucleic acid molecule or can be localized to discrete portions thereof. As an example of the latter, chimeric nucleic acids can be synthesized that have discrete DNA and RNA domains and that can be used for targeted gene repair and modified PCR reactions, as further described in, Misra et al., *Biochem.* 37: 1917-1925 (1998); and Finn et al., *Nucl. Acids Res.* 24: 3357-3363 (1996), and U.S. Pat. Nos. 5,760,012 and 5,731,181, the disclosures of which are incorporated herein by reference in their entireties.

Unless otherwise specified, nucleic acid molecules of the present invention can include any topological conformation appropriate to the desired use; the term thus explicitly comprehends, among others, single-stranded, double-stranded, triplexed, quadruplexed, partially double-stranded, partially-triplexed, partially-quadruplexed, branched, hairpinned, circular, and padlocked conformations. Padlock conformations and their utilities are further described in Banér et al., *Curr. Opin. Biotechnol.* 12: 11-15 (2001); Escude et al., *Proc. Natl. Acad. Sci. USA* 14: 96(19):10603-7 (1999); and Nilsson et al., *Science* 265(5181): 2085-8 (1994). Triplex and quadruplex conformations, and their utilities, are reviewed in Praseuth et al., *Biochim. Biophys. Acta.* 1489(1): 181-206 (1999); Fox, *Curr. Med. Chem.* 7(1): 17-37 (2000); Kochetkova et al., *Methods Mol. Biol.* 130: 189-201 (2000); Chan et al., *J. Mol. Med.* 75(4): 267-82 (1997); Rowley et al., *Mol Med* 5(10): 693-700 (1999); Kool, *Annu Rev Biophys Biomol Struct.* 25: 1-28 (1996).

Methods for Using Nucleic Acid Molecules as Probes and Primers

The isolated nucleic acid molecules of the present invention can be used as hybridization probes to detect, characterize, and quantify hybridizing nucleic acids in, and isolate hybridizing nucleic acids from, both genomic and transcript-derived nucleic acid samples. When free in solution, such probes are typically, but not invariably, detectably labeled; bound to a substrate, as in a microarray, such probes are typically, but not invariably unlabeled.

In one embodiment, the isolated nucleic acid molecules of the present invention can be used as probes to detect and characterize gross alterations in the gene of a OSNA, such as deletions, insertions, translocations, and duplications of the OSNA genomic locus through fluorescence in situ hybridization (FISH) to chromosome spreads. See, e.g., Andreeff et al. (eds.), *Introduction to Fluorescence In Situ Hybridization: Principles and Clinical Applications*, John Wiley & Sons (1999). The isolated nucleic acid molecules of the present invention can be used as probes to assess smaller genomic alterations using, e.g., Southern blot detection of restriction fragment length polymorphisms. The isolated nucleic acid molecules of the present invention can be used as probes to isolate genomic clones that include a nucleic acid molecule of the present invention, which thereafter can be restriction mapped and sequenced to identify deletions, insertions, translocations, and substitutions (single nucleotide polymorphisms, SNPs) at the sequence level. Alternatively, detection techniques such as molecular beacons may be used, see Kostrikis et al. *Science* 279:1228-1229(1998).

The isolated nucleic acid molecules of the present invention can be also be used as probes to detect, characterize, and quantify OSNA in, and isolate OSNA from, transcript-derived nucleic acid samples. In one embodiment, the isolated nucleic acid molecules of the present invention can be used as hybridization probes to detect, characterize by length, and quantify mRNA by Northern blot of total or poly-A$^+$-selected RNA samples. In another embodiment, the isolated nucleic acid molecules of the present invention can be used as hybridization probes to detect, characterize by location, and quantify mRNA by in situ hybridization to tissue sections. See, e.g., Schwarchzacher et al., *In Situ Hybridization*, Springer-Verlag New York (2000). In another preferred embodiment, the isolated nucleic acid molecules of the present invention can be used as hybridization probes to measure the representation of clones in a cDNA library or to isolate hybridizing nucleic acid molecules acids from cDNA libraries, permitting sequence level characterization of mRNAs that hybridize to OSNAs, including, without limitations, identification of deletions, insertions, substitutions, truncations, alternatively spliced forms and single nucleotide polymorphisms. In yet another preferred embodiment, the nucleic acid molecules of the instant invention may be used in microarrays.

All of the aforementioned probe techniques are well within the skill in the art, and are described at greater length in standard texts such as Sambrook (2001), supra; Ausubel (1999), supra; and Walker et al. (eds.), *The Nucleic Acids Protocols Handbook*, Humana Press (2000).

In another embodiment, a nucleic acid molecule of the invention may be used as a probe or primer to identify and/or amplify a second nucleic acid molecule that selectively hybridizes to the nucleic acid molecule of the invention. In this embodiment, it is preferred that the probe or primer be derived from a nucleic acid molecule encoding a OSP. More preferably, the probe or primer is derived from a nucleic acid molecule encoding a polypeptide having an amino acid sequence of SEQ ID NO: 249-396. Also preferred are probes or primers derived from a OSNA. More preferred are probes or primers derived from a nucleic acid molecule having a nucleotide sequence of SEQ ID NO: 1-248.

In general, a probe or primer is at least 10 nucleotides in length, more preferably at least 12, more preferably at least 14 and even more preferably at least 16 or 17 nucleotides in length. In an even more preferred embodiment, the probe or primer is at least 18 nucleotides in length, even more preferably at least 20 nucleotides and even more preferably at least 22 nucleotides in length. Primers and probes may also be longer in length. For instance, a probe or primer may be 25 nucleotides in length, or may be 30, 40 or 50 nucleotides in length. Methods of performing nucleic acid hybridization using oligonucleotide probes are well known in the art. See, e.g., Sambrook et al., 1989, supra, Chapter 11 and pp. 11.31-11.32 and 11.40-11.44, which describes radiolabeling of short probes, and pp. 11.45-11.53, which describe hybridization conditions for oligonucleotide probes, including specific conditions for probe hybridization (pp. 11.50-11.51).

Methods of performing primer-directed amplification are also well known in the art Methods for performing the polymerase chain reaction (PCR) are compiled, inter alia, in McPherson, *PCR Basics: From Background to Bench*, Springer Verlag (2000); Innis et al (eds.), *PCR Applications: Protocols for Functional Genomics*, Academic Press (1999); Gelfand et al. (eds.), *PCR Strategies*, Academic Press (1998); Newton et al., *PCR*, Springer-Verlag New York (1997); Burke (ed.), *PCR: Essential Techniques*, John Wiley & Son Ltd (1996); White (ed.), *PCR Cloning Protocols: From Molecular Cloning to Genetic Engineering*, Vol. 67, Humana Press (1996); and McPherson et al. (eds.), *PCR 2: A Practical Approach*, Oxford University Press, Inc. (1995). Methods for performing RT-PCR are collected, e.g., in Siebert et al. (eds.), *Gene Cloning and Analysis by RT-PCR*, Eaton Publishing Company/Bio Techniques Books Division, 1998; and Siebert (ed.), *PCR Technique: RT-PCR*, Eaton Publishing Company/BioTechniques Books (1995).

PCR and hybridization methods may be used to identify and/or isolate nucleic acid molecules of the present invention including allelic variants, homologous nucleic acid molecules and fragments. PCR and hybridization methods may also be used to identify, amplify and/or isolate nucleic acid molecules of the present invention that encode homologous proteins, analogs, fusion protein or muteins of the invention. Nucleic acid primers as described herein can be used to prime amplification of nucleic acid molecules of the invention, using transcript-derived or genomic DNA as template.

These nucleic acid primers can also be used, for example, to prime single base extension (SBE) for SNP detection (See, e.g., U.S. Pat. No. 6,004,744, the disclosure of which is incorporated herein by reference in its entirety).

Isothermal amplification approaches, such as rolling circle amplification, are also now well-described. See, e.g., Schweitzer et al., Curr. Opin. Biotechnol. 12(1): 21-7 (2001); international patent publications WO 97/19193 and WO 00/15779, and U.S. Pat. Nos. 5,854,033 and 5,714,320, the disclosures of which are incorporated herein by reference in their entireties. Rolling circle amplification can be combined with other techniques to facilitate SNP detection. See, e.g., Lizardi et al., Nature Genet. 19(3): 225-32 (1998).

Nucleic acid molecules of the present invention may be bound to a substrate either covalently or noncovalently. The substrate can be porous or solid, planar or non-planar, unitary or distributed. The bound nucleic acid molecules may be used as hybridization probes, and may be labeled or unlabeled. In a preferred embodiment, the bound nucleic acid molecules are unlabeled.

In one embodiment, the nucleic acid molecule of the present invention is bound to a porous substrate, e.g., a membrane, typically comprising nitrocellulose, nylon, or positively charged derivatized nylon. The nucleic acid molecule of the present invention can be used to detect a hybridizing nucleic acid molecule that is present within a labeled nucleic acid sample, e.g., a sample of transcript-derived nucleic acids. In another embodiment, the nucleic acid molecule is bound to a solid substrate, including, without limitation, glass, amorphous silicon, crystalline silicon or plastics. Examples of plastics include, without limitation, polymethylacrylic, polyethylene, polypropylene, polyacrylate, polymethylmethacrylate, polyvinylchloride, polytetrafluoroethylene, polystyrene, polycarbonate, polyacetal, polysulfone, celluloseacetate, cellulosenitrate, nitrocellulose, or mixtures thereof. The solid substrate may be any shape, including rectangular, disk-like and spherical. In a preferred embodiment, the solid substrate is a microscope slide or slide-shaped substrate.

The nucleic acid molecule of the present invention can be attached covalently to a surface of the support substrate or applied to a derivatized surface in a chaotropic agent that facilitates denaturation and adherence by presumed noncovalent interactions, or some combination thereof. The nucleic acid molecule of the present invention can be bound to a substrate to which a plurality of other nucleic acids are concurrently bound, hybridization to each of the plurality of bound nucleic acids being separately detectable. At low density, e.g. on a porous membrane, these substrate-bound collections are typically denominated macroarrays; at higher density, typically on a solid support, such as glass, these substrate bound collections of plural nucleic acids are colloquially termed microarrays. As used herein, the term microarray includes arrays of all densities. It is, therefore, another aspect of the invention to provide microarrays that comprise one or more of the nucleic acid molecules of the present invention.

In yet another embodiment, the invention is directed to single exon probes based on the OSNAs disclosed herein.

Expression Vectors, Host Cells and Recombinant Methods of Producing Polypeptides Another aspect of the present invention provides vectors that comprise one or more of the isolated nucleic acid molecules of the present invention, and host cells in which such vectors have been introduced.

The vectors can be used, inter alia, for propagating the nucleic acid molecules of the present invention in host cells (cloning vectors), for shuttling the nucleic acid molecules of the present invention between host cells derived from disparate organisms (shuttle vectors), for inserting the nucleic acid molecules of the present invention into host cell chromosomes (insertion vectors), for expressing sense or antisense RNA transcripts of the nucleic acid molecules of the present invention in vitro or within a host cell, and for expressing polypeptides encoded by the nucleic acid molecules of the present invention, alone or as fusion proteins with heterologous polypeptides (expression vectors). Vectors are by now well known in the art, and are described, inter alia, in Jones et al. (eds.), Vectors: Cloning Applications: Essential Techniques (Essential Techniques Series), John Wiley & Son Ltd. (1998); Jones et al. (eds.), Vectors: Expression Systems: Essential Techniques (Essential Techniques Series), John Wiley & Son Ltd. (1998); Gacesa et al., Vectors: Essential Data, John Wiley & Sons Ltd. (1995); Cid-Arregui (eds.), Viral Vectors: Basic Science and Gene Therapy, Eaton Publishing Co. (2000); Sambrook (2001), supra; Ausubel (1999), supra. Furthermore, a variety of vectors are available commercially. Use of existing vectors and modifications thereof are well within the skill in the art. Thus, only basic features need be described here.

Nucleic acid sequences may be expressed by operatively linking them to an expression control sequence in an appropriate expression vector and employing that expression vector to transform an appropriate unicellular host. Expression control sequences are sequences that control the transcription, post-transcriptional events and translation of nucleic acid sequences. Such operative linking of a nucleic sequence of this invention to an expression control sequence, of course, includes, if not already part of the nucleic acid sequence, the provision of a translation initiation codon, ATG or GTG, in the correct reading frame upstream of the nucleic acid sequence.

A wide variety of host/expression vector combinations may be employed in expressing the nucleic acid sequences of this invention. Useful expression vectors, for example, may consist of segments of chromosomal, non-chromosomal and synthetic nucleic acid sequences.

In one embodiment, prokaryotic cells may be used with an appropriate vector. Prokaryotic host cells are often used for cloning and expression. In a preferred embodiment, prokaryotic host cells include E. coli, Pseudomonas, Bacillus and Streptomyces. In a preferred embodiment, bacterial host cells are used to express the nucleic acid molecules of the instant invention. Useful expression vectors for bacterial hosts include bacterial plasmids, such as those from E. coli, Bacillus or Streptomyces, including pBluescript, pGEX-2T, pUC vectors, col E1, pCR1, pBR322, pMB9 and their derivatives, wider host range plasmids, such as RP4, phage DNAs, e.g., the numerous derivatives of phage lambda, e.g., NM989, λGT10 and λGT11, and other phages, e.g., M13 and filamentous single stranded phage DNA. Where E. coli is used as host, selectable markers are, analogously, chosen for selectivity in gram negative bacteria: e.g., typical markers confer resistance to antibiotics, such as ampicillin, tetracycline, chloramphenicol, kanamycin, streptomycin and zeocin; auxotrophic markers can also be used.

In other embodiments, eukaryotic-host cells, such as yeast, insect, mammalian or plant cells, may be used. Yeast cells, typically S. cerevisiae, are useful for eukaryotic genetic studies, due to the ease of targeting genetic changes by homologous recombination and the ability to easily complement genetic defects using recombinantly expressed proteins. Yeast cells are useful for identifying interacting protein components, e.g. through use of a two-hybrid system. In a preferred embodiment, yeast cells are useful for protein expression. Vectors of the present invention for use in yeast will typically, but not invariably, contain an origin of replication suitable for use in yeast and a selectable marker that is functional in yeast. Yeast vectors include Yeast Integrating plasmids (e.g., YIp5) and Yeast Replicating plasmids (the YRp and YEp series plasmids), Yeast Centromere plasmids (the YCp series plasmids), Yeast Artificial Chromosomes (YACs) which are based on yeast linear plasmids, denoted YLp, pGPD-2, 2µ plasmids and derivatives thereof, and improved shuttle vectors such as those described in Gietz et al., *Gene*, 74: 527-34 (1988) (YIplac, YEplac and YCplac). Selectable markers in yeast vectors include a variety of auxotrophic markers, the most common of which are (in *Saccharomyces cerevisiae*) URA3, HIS3, LEU2, TRP1 and LYS2, which complement specific auxotrophic mutations, such as ura3-52, his3-D1, leu2-D1, trp1-D1 and lys2-201.

Insect cells may be chosen for high efficiency protein expression. Where the host cells are from *Spodoptera frugiperda*, e.g., Sf9 and Sf21 cell lines, and expresSF™ cells (Protein Sciences Corp., Meriden, Conn., USA), the vector replicative strategy is typically based upon the baculovirus life cycle. Typically, baculovirus transfer vectors are used to replace the wild-type AcMNPV polyhedrin gene with a heterologous gene of interest. Sequences that flank the polyhedrin gene in the wild-type genome are positioned 5' and 3' of the expression cassette on the transfer vectors. Following co-transfection with AcMNPV DNA, a homologous recombination event occurs between these sequences resulting in a recombinant virus carrying the gene of interest and the polyhedrin or p10 promoter. Selection can be based upon visual screening for lacZ fusion activity.

The host cells may also be mammalian cells, which are particularly useful for expression of proteins intended as pharmaceutical agents, and for screening of potential agonists and antagonists of a protein or a physiological pathway. Mammalian vectors intended for autonomous extrachromosomal replication will typically include a viral origin, such as the SV40 origin (for replication in cell lines expressing the large T-antigen, such as COS1 and COS7 cells), the papillomavirus origin, or the EBV origin for long term episomal replication (for use, e.g., in 293-EBNA cells, which constitutively express the EBV EBNA-1 gene product and adenovirus E1A). Vectors intended for integration, and thus replication as part of the mammalian chromosome, can, but need not, include an origin of replication functional in mammalian cells, such as the SV40 origin. Vectors based upon viruses, such as adenovirus, adeno-associated virus, vaccinia virus, and various mammalian retroviruses, will typically replicate according to the viral replicative strategy. Selectable markers for use in mammalian cells include, include but are not limited to, resistance to neomycin (G418), blasticidin, hygromycin and zeocin, and selection based upon the purine salvage pathway using HAT medium.

Expression in mammalian cells can be achieved using a variety of plasmids, including pSV2, pBC12BI, and p91023, as well as lytic virus vectors (e.g., vaccinia virus, adeno virus, and baculovirus), episomal virus vectors (e.g., bovine papillomavirus), and retroviral vectors (e.g., murine retroviruses). Useful vectors for insect cells include baculoviral vectors and pVL 941.

Plant cells can also be used for expression, with the vector replicon typically derived from a plant virus (e.g., cauliflower mosaic virus, CaMV; tobacco mosaic virus, TMV) and selectable markers chosen for suitability in plants.

It is known that codon usage of different host cells may be different For example, a plant cell and a human cell may exhibit a difference in codon preference for encoding a particular amino acid. As a result, human mRNA may not be efficiently translated in a plant, bacteria or insect host cell. Therefore, another embodiment of this invention is directed to codon optimization. The codons of the nucleic acid molecules of the invention may be modified to resemble, as much as possible, genes naturally contained within the host cell without altering the amino acid sequence encoded by the nucleic acid molecule.

Any of a wide variety of expression control sequences may be used in these vectors to express the nucleic acid molecules of this invention. Such useful expression control sequences include the expression control sequences associated with structural genes of the foregoing expression vectors. Expression control sequences that control transcription include, e.g., promoters, enhancers and transcription termination sites. Expression control sequences in eukaryotic cells that control post-transcriptional events include splice donor and acceptor sites and sequences that modify the half-life of the transcribed RNA, e.g., sequences that direct poly(A) addition or binding sites for RNA-binding proteins. Expression control sequences that control translation include ribosome binding sites, sequences which direct targeted expression of the polypeptide to or within particular cellular compartments, and sequences in the 5' and 3' untranslated regions that modify the rate or efficiency of translation.

Examples of useful expression control sequences for a prokaryote, e.g. *E. coli*, will include a promoter, often a phage promoter, such as phage lambda pL promoter, the trc promoter, a hybrid derived from the trp and lac promoters, the bacteriophage T7 promoter (in *E. coli* cells engineered to express the T7 polymerase), the TAC or TRC system, the major operator and promoter regions of phage lambda, the control regions of fd coat protein, and the araBAD operon. Prokaryotic expression vectors may further include transcription terminators, such as the aspA terminator, and elements that facilitate translation, such as a consensus ribosome binding site and translation termination codon, Schomer et al., *Proc. Natl. Acad. Sci. USA* 83: 8506-8510 (1986).

Expression control sequences for yeast cells, typically *S. cerevisiae*, will include a yeast promoter, such as the CYC1 promoter, the GAL1 promoter, the GAL10 promoter, ADH1 promoter, the promoters of the yeast α-mating system, or the GPD promoter, and will typically have elements that facilitate transcription termination, such as the transcription termination signals from the CYC1 or ADH1 gene.

Expression vectors useful for expressing proteins in mammalian cells will include a promoter active in mammalian cells. These promoters include, but are not limited to, those derived from mammalian viruses, such as the enhancer-promoter sequences from the immediate early gene of the human cytomegalovirus (CMV), the enhancer-promoter sequences from the Rous sarcoma virus long terminal repeat (RSV LTR), the enhancer-promoter from SV40 and the early and late promoters of adenovirus. Other expression control sequences include the promoter for 3-phosphoglycerate kinase or other glycolytic enzymes, the promoters of acid phosphatase. Other expression control sequences include those from the gene comprising the OSNA of interest. Often, expression is enhanced by incorporation of polyadenylation sites, such as the late SV40 polyadenylation site and the polyadenylation signal and transcription termination sequences from the bovine growth hormone (BGH) gene, and ribosome binding sites. Furthermore, vectors can include introns, such as intron II of rabbit β-globin gene and the SV40 splice elements.

Preferred nucleic acid vectors also include a selectable or amplifiable marker gene and means for amplifying the copy number of the gene of interest. Such marker genes are well known in the art Nucleic acid vectors may also comprise stabilizing sequences (e.g., ori- or A-RS-like sequences and telomere-like sequences), or may alternatively be designed to favor directed or non-directed integration into the host cell genome. In a preferred embodiment, nucleic acid sequences of this invention are inserted in frame into an expression vector that allows a high level expression of an RNA which encodes a protein comprising the encoded nucleic acid sequence of interest. Nucleic acid cloning and sequencing methods are well known to those of skill in the art and are described in an assortment of laboratory manuals, including Sambrook (1989), supra, Sambrook (2000), supra; and Ausubel (1992), supra, Ausubel (1999), supra. Product information from manufacturers of biological, chemical and immunological reagents also provide useful information.

Expression vectors may be either constitutive or inducible. Inducible vectors include either naturally inducible promoters, such as the trc promoter, which is regulated by the lac operon, and the pL promoter, which is regulated by tryptophan, the MMTV-LTR promoter, which is inducible by dexamethasone, or can contain synthetic promoters and/or additional elements that confer inducible control on adjacent promoters. Examples of inducible synthetic promoters are the hybrid Plac/ara-1 promoter and the PLtetO-1 promoter. The PLtetO-1 promoter takes advantage of the high expression levels from the PL promoter of phage lambda, but replaces the lambda repressor sites with two copies of operator 2 of the Tn10 tetracycline resistance operon, causing this promoter to be tightly repressed by the Tet repressor protein and induced in response to tetracycline (Tc) and Tc derivatives such as anhydrotetracycline. Vectors may also be inducible because they contain hormone response elements, such as the glucocorticoid response element (GRE) and the estrogen response element (ERE), which can confer hormone inducibility where vectors are used for expression in cells having the respective hormone receptors. To reduce background levels of expression, elements responsive to ecdysone, an insect hormone, can be used instead, with coexpression of the ecdysone receptor.

In one embodiment of the invention, expression vectors can be designed to fuse the expressed polypeptide to small protein tags that facilitate purification and/or visualization. Such tags include a polyhistidine tag that facilitates purification of the fusion protein by immobilized metal affinity chromatography, for example using NiNTA resin (Qiagen Inc., Valencia, Calif., USA) or TALON™ resin (cobalt immobilized affinity chromatography medium, Clontech Labs, Palo Alto, Calif., USA). The fusion protein can include a chitin-binding tag and self-excising intein, permitting chitin-based purification with self-removal of the fused tag (IMPACT™ system, New England Biolabs, Inc., Beverley, Mass., USA). Alternatively, the fusion protein can include a calmodulin-binding peptide tag, permitting purification by calmodulin affinity resin (Stratagene, La Jolla, Calif., USA), or a specifically excisable fragment of the biotin carboxylase carrier protein, permitting purification of in vivo biotinylated protein using an avidin resin and subsequent tag removal (Promega, Madison, Wis., USA). As another useful alternative, the polypeptides of the present invention can be expressed as a fusion to glutathione-S-transferase, the affinity and specificity of binding to glutathione permitting purification using glutathione affinity resins, such as Glutathione-Superflow Resin (Clontech Laboratories, Palo Alto, Calif., USA), with subsequent elution with free glutathione. Other tags include, for example, the Xpress epitope, detectable by anti-Xpress antibody (Invitrogen, Carlsbad, Calif., USA), a myc tag, detectable by anti-myc tag antibody, the V5 epitope, detectable by anti-V5 antibody (Invitrogen, Carlsbad, Calif., USA), FLAG® epitope, detectable by anti-FLAG® antibody (Stratagene, La Jolla, Calif., USA), and the HA epitope, detectable by anti-HA antibody.

For secretion of expressed polypeptides, vectors can include appropriate sequences that encode secretion signals, such as leader peptides. For example, the pSecTag2 vectors (Invitrogen, Carlsbad, Calif., USA) are 5.2 kb mammalian expression vectors that carry the secretion signal from the V-J2-C region of the mouse Ig kappa-chain for efficient secretion of recombinant proteins from a variety of mammalian cell lines.

Expression vectors can also be designed to fuse proteins encoded by the heterologous nucleic acid insert to polypeptides that are larger than purification and/or identification tags. Useful protein fusions include those that permit display of the encoded protein on the surface of a phage or cell, fusions to intrinsically fluorescent proteins, such as those that have a green fluorescent protein (GFP)-like chromophore, fusions to the IgG Fc region, and fusions for use in two hybrid systems.

Vectors for phage display fuse the encoded polypeptide to, e.g., the gene m protein (pIII) or gene VIII protein (pVIII) for display on the surface of filamentous phage, such as M13. See Barbas et al., *Phage Display: A Laboratory Manual*, Cold Spring Harbor Laboratory Press (2001); Kay et al. (eds.), *Phage Display of Peptides and Proteins: A Laboratory Manual*, Academic Press, Inc., (1996); Abelson et al. (eds.), *Combinatorial Chemistry* (Methods in Enzymology, Vol. 267) Academic Press (1996). Vectors for yeast display, e.g. the pYD1 yeast display vector (Invitrogen, Carlsbad, Calif., USA), use the α-agglutinin yeast adhesion receptor to display recombinant protein on the surface of *S. cerevisiae*. Vectors for mammalian display, e.g., the pDisplay™ vector (Invitrogen, Carlsbad, Calif., USA), target recombinant proteins using an N-terminal cell surface targeting signal and a C-terminal transmembrane anchoring domain of platelet derived growth factor receptor.

A wide variety of vectors now exist that fuse proteins encoded by heterologous nucleic acids to the chromophore of the substrate-independent, intrinsically fluorescent green fluorescent protein from *Aequorea victoria* ("GFP") and its variants. The GFP-like chromophore can be selected from GFP-like chromophores found in naturally occurring proteins, such as *A. victoria* GFP (GenBank accession number AAA27721), *Renilla reniformis* GFP, FP583 (GenBank accession no. AF168419) (DsRed), FP593 (AF272711), FP483 (AF168420), FP484 (AF168424), FP595 (AF246709), FP486 (AF168421), FP538 (AF168423), and FP506 (AF168422), and need include only so much of the native protein as is needed to retain the chromophore's intrinsic fluorescence. Methods for determining the minimal domain required for fluorescence are known in the art. See Li et al., *J. Biol. Chem.* 272: 28545-28549 (1997). Alternatively, the GFP-like chromophore can be selected from GFP-like chromophores modified from those found in nature. The methods for engineering such modified GFP-like chromophores and testing them for fluorescence activity, both alone and as part of protein fusions, are well known in the art. See Reim et al., *Curr. Biol.* 6: 178-182 (1996) and Palm et al., *Methods Enzymol.* 302: 378-394 (1999). A variety of such modified chromophores are now commercially available and can readily be used in the fusion proteins of the present invention. These include EGFP ("enhanced GFP"), EBFP ("enhanced blue fluorescent protein"), BFP2, EYFP ("enhanced yellow fluorescent protein"), ECFP ("enhanced cyan fluorescent protein") or Citrine. EGFP (see, e.g, Cormack et al., Gene 173: 33-38 (1996); U.S. Pat. Nos. 6,090,919 and 5,804,387, the disclosures of which are incorporated herein by reference in their entireties) is found on a variety of vectors, both plasmid and viral, which are available commercially (Clontech Labs, Palo Alto, Calif., USA); EBFP is optimized for expression in mammalian cells whereas BFP2, which retains the original jellyfish codons, can be expressed in bacteria (see, e.g., Heim et al., Curr. Biol. 6: 178-182 (1996) and Cormack et al., Gene 173: 33-38 (1996)). Vectors containing these blue-shifted variants are available from Clontech Labs (Palo Alto, Calif., USA). Vectors containing EYFP, ECFP (see, e.g., Heim et al., Curr. Biol. 6: 178-182 (1996); Miyawaki et al., Nature 388: 882-887 (1997)) and Citrine (see, e.g., Heikal et al., Proc. Natl. Acad. Sci. USA 97: 11996-12001 (2000)) are also available from Clontech Labs. The GFP-like chromophore can also be drawn from other modified GFPs, including those described in U.S. Pat. Nos. 6,124,128; 6,096,865; 6,090,919; 6,066,476; 6,054,321; 6,027,881; 5,968,750; 5,874,304; 5,804,387; 5,777,079; 5,741,668; and 5,625,048, the disclosures of which are incorporated herein by reference in their entireties. See also Conn (ed.), Green Fluorescent Protein (Methods in Enzymology, Vol. 302), Academic Press, Inc. (1999); Yang, et al., J. Biol Chem, 273: 8212-6 (1998); Bevis et al., Nature Biotechnology, 20:83-7 (2002). The GFP-like chromophore of each of these GFP variants can usefully be included in the fusion proteins of the present invention.

Fusions to the IgG Fc region increase serum half-life of protein pharmaceutical products through interaction with the FcRn receptor (also denominated the FcRp receptor and the Brambell receptor, FcRb), further described in International Patent Application nos. WO 97/43316, WO 97/34631, WO 96/32478, WO 96/18412, the disclosures of which are incorporated herein by reference in their entireties.

For long-term, high-yield recombinant production of the polypeptides of the present invention, stable expression is preferred. Stable expression is readily achieved by integration into the host cell genome of vectors having selectable markers, followed by selection of these integrants. Vectors such as pUB6/V5-His A, B, and C (Invitrogen, Carlsbad, Calif., USA) are designed for high-level stable expression of heterologous proteins in a wide range of mammalian tissue types and cell lines. pUB6/V5-His uses the promoter/enhancer sequence from the human ubiquitin C gene to drive expression of recombinant proteins: expression levels in 293, CHO, and NIH3T3 cells are comparable to levels from the CMV and human EF-1a promoters. The bsd gene permits rapid selection of stably transfected mammalian cells with the potent antibiotic blasticidin.

Replication incompetent retroviral vectors, typically derived from Moloney murine leukemia virus, also are useful for creating stable transfectants having integrated provirus. The highly efficient transduction machinery of retroviruses, coupled with the availability of a variety of packaging cell lines such as RetroPack™ PT 67, EcoPack2™-293, AmphoPack-293, and GP2-293 cell lines (all available from Clontech Laboratories, Palo Alto, Calif., USA) allow a wide host range to be infected with high efficiency; varying the multiplicity of infection readily adjusts the copy number of the integrated provirus.

Of course, not all vectors and expression control sequences will function equally well to express the nucleic acid molecules of this invention. Neither will all hosts function equally well with the same expression system. However, one of skill in the art may make a selection among these vectors, expression control sequences and hosts without undue experimentation and without departing from the scope of this invention. For example, in selecting a vector, the host must be considered because the vector must be replicated in it. The vector's copy number, the ability to control that copy number, the ability to control integration, if any, and the expression of any other proteins encoded by the vector, such as antibiotic or other selection markers, should also be considered. The present invention further includes host cells comprising the vectors of the present invention, either present episomally within the cell or integrated, in whole or in part, into the host cell chromosome. Among other considerations, some of which are described above, a host cell strain may be chosen for its ability to process the expressed polypeptide in the desired fashion. Such post-translational modifications of the polypeptide include, but are not limited to, acetylation, carboxylation, glycosylation, phosphorylation, lipidation, and acylation, and it is an aspect of the present invention to provide OSPs with such post-translational modifications.

In selecting an expression control sequence, a variety of factors should also be considered. These include, for example, the relative strength of the sequence, its controllability, and its compatibility with the nucleic acid molecules of this invention, particularly with regard to potential secondary structures. Unicellular hosts should be selected by consideration of their compatibility with the chosen vector, the toxicity of the product coded for by the nucleic acid sequences of this invention, their secretion characteristics, their ability to fold the polypeptide correctly, their fermentation or culture requirements, and the ease of purification from them of the products coded for by the nucleic acid molecules of this invention.

The recombinant nucleic acid molecules and more particularly, the expression vectors of this invention may be used to express the polypeptides of this invention as recombinant polypeptides in a heterologous host cell. The polypeptides of this invention may be full-length or less than full-length polypeptide fragments recombinantly expressed from the nucleic acid molecules according to this invention. Such polypeptides include analogs, derivatives and muteins that may or may not have biological activity.

Vectors of the present invention will also often include elements that permit in vitro transcription of RNA from the inserted heterologous nucleic acid. Such vectors typically include a phage promoter, such as that from T7, T3, or SP6, flanking the nucleic acid insert. Often two different such promoters flank the inserted nucleic acid, permitting separate in vitro production of both sense and antisense strands.

Transformation and other methods of introducing nucleic acids into a host cell (e.g., conjugation, protoplast transformation or fusion, transfection, electroporation, liposome delivery, membrane fusion techniques, high velocity DNA-coated pellets, viral infection and protoplast fusion) can be accomplished by a variety of methods which are well known in the art (See, for instance, Ausubel, supra, and Sambrook et al., supra). Bacterial, yeast, plant or mammalian cells are transformed or transfected with an expression vector, such as a plasmid, a cosmid, or the like, wherein the expression vector comprises the nucleic acid of interest. Alternatively, the cells may be infected by a viral expression vector comprising the nucleic acid of interest. Depending upon the host cell, vector, and method of transformation used, transient or stable expression of the polypeptide will be constitutive or inducible. One having ordinary skill in the art will be able to decide whether to express a polypeptide transiently or stably, and whether to express the protein constitutively or inducibly.

A wide variety of unicellular host cells are useful in expressing the DNA sequences of this invention. These hosts may include well known eukaryotic and prokaryotic hosts, such as strains of, fungi, yeast, insect cells such as *Spodoptera frugiperda* (SF9), animal cells such as CHO, as well as plant cells in tissue culture. Representative examples of appropriate host cells include, but are not limited to, bacterial cells, such as *E. coli, Caulobacter crescentus, Streptomyces* species, and *Salmonella typhimurium*; yeast cells, such as *Saccharomyces cerevisiae, Schizosaccharomyces pombe, Pichia pastoris, Pichia methanolica*; insect cell lines, such as those from *Spodoptera frugiperda*—e.g., Sf9 and Sf21 cell lines, and expresSF™ cells (Protein Sciences Corp., Meriden, Conn., USA)—*Drosophila* S2 cells, and *Trichoplusia ni* High Five® Cells (Invitrogen, Carlsbad, Calif., USA); and mammalian cells. Typical mammalian cells include BHK cells, BSC 1 cells, BSC 40 cells, BMT 10 cells, VERO cells, COS1 cells, COS7 cells, Chinese hamster ovary (CHO) cells, 3T3 cells, NIH-3T3 cells, 293 cells, HEPG2 cells, HeLa cells, L cells, MDCK cells, HEK293 cells, WI38 cells, murine ES cell lines (e.g., from strains 129/SV, C57/BL6, DBA-1, 129/SVJ), K562 cells, Jurkat cells, and BW5147 cells. Other mammalian cell lines are well known and readily available from the American Type Culture Collection (ATCC) (Manassas, Va., USA) and the National Institute of General Medical Sciences (NIGMS) Human Genetic Cell Repository at the Coriell Cell Repositories (Camden, N.J., USA). Cells or cell lines derived from ovarian are particularly preferred because they may provide a more native post-translational processing. Particularly preferred are human ovarian cells.

Particular details of the transfection, expression and purification of recombinant proteins are well documented and are understood by those of skill in the art. Further details on the various technical aspects of each of the steps used in recombinant production of foreign genes in bacterial cell expression systems can be found in a number of texts and laboratory manuals in the art. See, e.g., Ausubel (1992), supra, Ausubel (1999), supra, Sambrook (1989), supra, and Sambrook (2001), supra.

Methods for introducing the vectors and nucleic acid molecules of the present invention into the host cells are well known in the art; the choice of technique will depend primarily upon the specific vector to be introduced and the host cell chosen.

Nucleic acid molecules and vectors may be introduced into prokaryotes, such as *E. coli*, in a number of ways. For instance, phage lambda vectors will typically be packaged using a packaging extract (e.g., Gigapack® packaging extract, Stratagene, La Jolla, Calif., USA), and the packaged virus used to infect *E. coli*.

Plasmid vectors will typically be introduced into chemically competent or electrocompetent bacterial cells. *E. coli* cells can be rendered chemically competent by treatment, e.g., with $CaCl_2$, or a solution of $Mg^{2+}$, $Mn^{2+}$, $Ca^{2+}$, $Rb^+$ or $K^+$, dimethyl sulfoxide, dithiothreitol, and hexamine cobalt (III), Hanahan, *J. Mol. Biol.* 166(4):557-80 (1983), and vectors introduced by heat shock. A wide variety of chemically competent strains are also available commercially (e.g., Epicurian Coli® XL 10-Gold® Ultracompetent Cells (Stratagene, La Jolla, Calif., USA); DH5α competent cells (Clontech Laboratories, Palo Alto, Calif., USA); and TOP10 Chemically Competent *E. coli* Kit (Invitrogen, Carlsbad, Calif., USA)). Bacterial cells can be rendered electrocompetent to take up exogenous DNA by electroporation by various pre-pulse treatments; vectors are introduced by electroporation followed by subsequent outgrowth in selected media. An extensive series of protocols is provided by BioRad (Richmond, Calif., USA).

Vectors can be introduced into yeast cells by spheroplasting, treatment with lithium salts, electroporation, or protoplast fusion. Spheroplasts are prepared by the action of hydrolytic enzymes such as a snail-gut extract usually denoted Glusulase or Zymolyase, or an enzyme from *Arthrobacter luteus* to remove portions of the cell wall in the presence of osmotic stabilizers, typically 1 M sorbitol. DNA is added to the spheroplasts, and the mixture is co-precipitated with a solution of polyethylene glycol (PEG) and $Ca^{2+}$. Subsequently, the cells are resuspended in a solution of sorbitol, mixed with molten agar and then layered on the surface of a selective plate containing sorbitol.

For lithium-mediated transformation, yeast cells are treated with lithium acetate to permeabilize the cell wall, DNA is added and the cells are co-precipitated with PEG. The cells are exposed to a brief heat shock, washed free of PEG and lithium acetate, and subsequently spread on plates containing ordinary selective medium. Increased frequencies of transformation are obtained by using specially-prepared single-stranded carrier DNA and certain organic solvents. Schiestl et al, *Curr. Genet.* 16(5-6): 33946 (1989).

For electroporation, freshly-grown yeast cultures are typically washed, suspended in an osmotic protectant, such as sorbitol, mixed with DNA, and the cell suspension pulsed in an electroporation device. Subsequently, the cells are spread on the surface of plates containing selective media. Becker et al., *Methods Enzymol.* 194: 182-187 (1991). The efficiency of transformation by electroporation can be increased over 100-fold by using PEG, single-stranded carrier DNA and cells that are in late log-phase of growth. Larger constructs, such as YACs, can be introduced by protoplast fusion.

Mammalian and insect cells can be directly infected by packaged viral vectors, or transfected by chemical or electrical means. For chemical transfection, DNA can be coprecipitated with $CaPO_4$ or introduced using liposomal and nonliposomal lipid-based agents. Commercial kits are available for $CaPO_4$ transfection (CalPhos™ Mammalian Transfection Kit, Clontech Laboratories, Palo Alto, Calif., USA), and lipid-mediated transfection can be practiced using commercial reagents, such as LIPOFECTAMINE™ 2000, LIPOFECTAMINE™ Reagent, CELLFECTIN® Reagent, and LIPOFECTIN® Reagent (Invitrogen, Carlsbad, Calif., USA), DOTAP Liposomal Transfection Reagent, FuGENE 6, X-tremeGENE Q2, DOSPER, (Roche Molecular Biochemicals, Indianapolis, Ind. USA), Effectene™, PolyFect®, Superfect® (Qiagen, Inc., Valencia, Calif., USA). Protocols for electroporating mammalian cells can be found in, for example, Norton et al. (eds.), *Gene Transfer Methods: Introducing DNA into Living Cells and Organisms*, BioTechniques Books, Eaton Publishing Co. (2000). Other transfection techniques include transfection by particle bombardment and microinjection. See, e.g., Cheng et al., *Proc. Natl. Acad. Sci. USA* 90(10): 4455-9 (1993); Yang et al., *Proc. Natl. Acad. Sci. USA* 87(24): 9568-72 (1990).

Production of the recombinantly produced proteins of the present invention can optionally be followed by purification.

Purification of recombinantly expressed proteins is now well within the skill in the art and thus need not be detailed here. See, e.g., Thorner et al. (eds.), *Applications of Chimeric Genes and Hybrid Proteins. Part A: Gene Expression and Protein Purification* (Methods in Enzymology, Vol. 326), Academic Press (2000); Harbin (ed.), *Cloning, Gene Expres-* sion and Protein Purification: Experimental Procedures and Process Rationale, Oxford Univ. Press (2001); Marshak et al., Strategies for Protein Purification and Characterization: A Laboratory Course Manual, Cold Spring Harbor Laboratory Press (1996); and Roe (ed.), Protein Purification Applications, Oxford University Press (2001).

Briefly, however, if purification tags have been fused through use of an expression vector that appends such tag, purification can be effected, at least in part, by means appropriate to the tag, such as use of immobilized metal affinity chromatography for polyhistidine tags. Other techniques common in the art include ammonium sulfate fractionation, immunoprecipitation, fast protein liquid chromatography (FPLC), high performance liquid chromatography (HPLC), and preparative gel electrophoresis.

Polypeptides, Including Fragments Muteins, Homologous Proteins, Allelic Variants, Analogs and Derivatives Another aspect of the invention relates to polypeptides encoded by the nucleic acid molecules described herein. In a preferred embodiment, the polypeptide is a ovarian specific polypeptide (OSP). In an even more preferred embodiment, the polypeptide comprises an amino acid sequence of SEQ ID NO:249-396 or is derived from a polypeptide having the amino acid sequence of SEQ ID NO: 249-396. A polypeptide as defined herein may be produced recombinantly, as discussed supra, may be isolated from a cell that naturally expresses the protein, or may be chemically synthesized following the teachings of the specification and using methods well known to those having ordinary skill in the art.

Polypeptides of the present invention may also comprise a part or fragment of a OSP. In a preferred embodiment, the fragment is derived from a polypeptide having an amino acid sequence selected from the group consisting of SEQ ID NO: 249-396. Polypeptides of the present invention comprising a part or fragment of an entire OSP may or may not be OSPs. For example, a full-length polypeptide may be ovarian-specific, while a fragment thereof may be found in other tissues as well as in ovarian. A polypeptide that is not a OSP, whether it is a fragment, analog, mutein, homologous protein or derivative, is nevertheless useful, especially for immunizing animals to prepare anti-OSP antibodies. In a preferred embodiment, the part or fragment is a OSP. Methods of determining whether a polypeptide of the present invention is a OSP are described infra.

Polypeptides of the present invention comprising fragments of at least 6 contiguous amino acids are also useful in mapping B cell and T cell epitopes of the reference protein. See, e.g., Geysen et al., Proc. Natl. Acad. Sci. USA 81: 39984002 (1984) and U.S. Pat. Nos. 4,708,871 and 5,595, 915, the disclosures of which are incorporated herein by reference in their entireties. Because the fragment need not itself be immunogenic, part of an immunodominant epitope, nor even recognized by native antibody, to be useful in such epitope mapping, all fragments of at least 6 amino acids of a polypeptide of the present invention have utility in such a study.

Polypeptides of the present invention comprising fragments of at least 8 contiguous amino acids, often at least 15 contiguous amino acids, are useful as immunogens for raising antibodies that recognize polypeptides of the present invention. See, e.g., Lerner, Nature 299: 592-596 (1982); Shinnick et al., Annu. Rev. Microbiol. 37: 42546 (1983); Sutcliffe et al., Science 219: 660-6 (1983). As further described in the above-cited references, virtually all 8-mers, conjugated to a carrier, such as a protein, prove immunogenic and are capable of eliciting anti-body for the conjugated peptide; accordingly, all fragments of at least 8 amino acids of the polypeptides of the present invention have utility as immunogens.

Polypeptides comprising fragments of at least 8, 9, 10 or 12 contiguous amino acids are also useful as competitive inhibitors of binding of the entire polypeptide, or a portion thereof, to antibodies (as in epitope mapping), and to natural binding partners, such as subunits in a multimeric complex or to receptors or ligands of the subject protein; this competitive inhibition permits identification and separation of molecules that bind specifically to the polypeptide of interest See U.S. Pat. Nos. 5,539,084 and 5,783,674, incorporated herein by reference in their entireties.

The polypeptide of the present invention thus preferably is at least 6 amino acids in length, typically at least 8, 9, 10 or 12 amino acids in length, and often at least 15 amino acids in length Often, the polypeptide of the present invention is at least 20 amino acids in length, even 25 amino acids, 30 amino acids, 35 amino acids, or 50 amino acids or more in length. Of course, larger polypeptides having at least 75 amino acids, 100 amino acids, or even 150 amino acids are also useful, and at times preferred.

One having ordinary skill in the art can produce fragments by truncating the nucleic acid molecule, e.g., a OSNA, encoding the polypeptide and then expressing it recombinantly. Alternatively, one can produce a fragment by chemically synthesizing a portion of the full-length polypeptide. One may also produce a fragment by enzymatically cleaving either a recombinant polypeptide or an isolated naturally occurring polypeptide. Methods of producing polypeptide fragments are well known in the art See, e.g., Sambrook (1989), supra; Sambrook (2001), supra; Ausubel (1992), supra; and Ausubel (1999), supra. In one embodiment, a polypeptide comprising only a fragment, preferably a fragment of a OSP, may be produced by chemical or enzymatic cleavage of a OSP polypeptide. In a preferred embodiment, a polypeptide fragment is produced by expressing a nucleic acid molecule of the present invention encoding a fragment, preferably of a OSP, in a host cell.

Polypeptides of the present invention are also inclusive of mutants, fusion proteins, homologous proteins and allelic variants.

A mutant protein, or mutein, may have the same or different properties compared to a naturally occurring polypeptide and comprises at least one amino acid insertion, duplication, deletion, rearrangement or substitution compared to the amino acid sequence of a native polypeptide. Small deletions and insertions can often be found that do not alter the function of a protein. Muteins may or may not be ovarian-specific. Preferably, the mutein is ovarian-specific. More preferably the mutein is a polypeptide that comprises at least one amino acid insertion, duplication, deletion, rearrangement or substitution compared to the amino acid sequence of SEQ ID NO: 249-396. Accordingly, in a preferred embodiment, the mutein is one that exhibits at least 50% sequence identity, more preferably at least 60% sequence identity, even more preferably at least 70%, yet more preferably at least 80% sequence identity to a OSP comprising an amino acid sequence of SEQ ID NO: 249-396. In a yet more preferred embodiment, the mutein exhibits at least 85%, more preferably 90%, even more preferably 95% or 96%, and yet more preferably at least 97%, 98%, 99% or 99.5% sequence identity to a OSP comprising an amino acid sequence of SEQ ID NO: 249-396.

A mutein may be produced by isolation from a naturally occurring mutant cell, tissue or organism. A mutein may be produced by isolation from a cell, tissue or organism that has been experimentally mutagenized. Alternatively, a mutein may be produced by chemical manipulation of a polypeptide, such as by altering the amino acid residue to another amino acid residue using synthetic or semi-synthetic chemical techniques. In a preferred embodiment, a mutein is produced from a host cell comprising a mutated nucleic acid molecule compared to the naturally occurring nucleic acid molecule. For instance, one may produce a mutein of a polypeptide by introducing one or more mutations into a nucleic acid molecule of the invention and then expressing it recombinantly. These mutations may be targeted, in which particular encoded amino acids are altered, or may be untargeted, in which random encoded amino acids within the polypeptide are altered. Muteins with random amino acid alterations can be screened for a particular biological activity or property, particularly whether the polypeptide is ovarian-specific, as described below. Multiple random mutations can be introduced into the gene by methods well known to the art, e.g., by error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis and site-specific mutagenesis. Methods of producing muteins with targeted or random amino acid alterations are well known in the art. See, e.g., Sambrook (1989), supra; Sambrook (2001), supra; Ausubel (1992), supra; and Ausubel (1999), as well as U.S. Pat. No. 5,223,408, which is herein incorporated by reference in its entirety.

The invention also contemplates polypeptides that are homologous to a polypeptide of the invention. In a preferred embodiment, the polypeptide is homologous to a OSP. In an even more preferred embodiment, the polypeptide is homologous to a OSP selected from the group having an amino acid sequence of SEQ ID NO: 249-396. By homologous polypeptide it is means one that exhibits significant sequence identity to a OSP, preferably a OSP having an amino acid sequence of SEQ ID NO: 249-396. By significant sequence identity it is meant that the homologous polypeptide exhibits at least 50% sequence identity, more preferably at least 60% sequence identity, even more preferably at least 70%, yet more preferably at least 80% sequence identity to a OSP comprising an amino acid sequence of SEQ ID NO: 249-396. More preferred are homologous polypeptides exhibiting at least 85%, more preferably 90%, even more preferably 95% or 96%, and yet more preferably at least 97% or 98% sequence identity to a OSP comprising an amino acid sequence of SEQ ID NO: 249-396. Most preferably, the homologous polypeptide exhibits at least 99%, more preferably 99.5%, even more preferably 99.6%, 99.7%, 99.8% or 99.9% sequence identity to a OSP comprising an amino acid sequence of SEQ ID NO: 249-396. In a preferred embodiment, the amino acid substitutions of the homologous polypeptide are conservative amino acid substitutions as discussed above.

Homologous polypeptides of the present invention also comprise polypeptide encoded by a nucleic acid molecule that selectively hybridizes to a OSNA or an antisense sequence thereof. In this embodiment, it is preferred that the homologous polypeptide be encoded by a nucleic acid molecule that hybridizes to a OSNA under low stringency, moderate stringency or high stringency conditions, as defined herein. More preferred is a homologous polypeptide encoded by a nucleic acid sequence which hybridizes to a OSNA selected from the group consisting of SEQ ID NO: 1-248 or a homologous polypeptide encoded by a nucleic acid molecule that hybridizes to a nucleic acid molecule that encodes a OSP, preferably an OSP of SEQ ID NO:249-396 under low stringency, moderate stringency or high stringency conditions, as defined herein.

Homologous polypeptides of the present invention may be naturally occurring and derived from another species, especially one derived from another primate, such as chimpanzee, gorilla, rhesus macaque, or baboon, wherein the homologous polypeptide comprises an amino acid sequence that exhibits significant sequence identity to that of SEQ ID NO: 249-396. The homologous polypeptide may also be a naturally occurring polypeptide from a human, when the OSP is a member of a family of polypeptides. The homologous polypeptide may also be a naturally occurring polypeptide derived from a non-primate, mammalian species, including without limitation, domesticated species, e.g., dog, cat, mouse, rat, rabbit, guinea pig, hamster, cow, horse, goat or pig. The homologous polypeptide may also be a naturally occurring polypeptide derived from a non-mammalian species, such as birds or reptiles. The naturally occurring homologous protein may be isolated directly from humans or other species. Alternatively, the nucleic acid molecule encoding the naturally occurring homologous polypeptide may be isolated and used to express the homologous polypeptide recombinantly. The homologous polypeptide may also be one that is experimentally produced by random mutation of a nucleic acid molecule and subsequent expression of the nucleic acid molecule. Alternatively, the homologous polypeptide may be one that is experimentally produced by directed mutation of one or more codons to alter the encoded amino acid of a OSP. In a preferred embodiment, the homologous polypeptide encodes a polypeptide that is a OSP.

Relatedness of proteins can also be characterized using a second functional test, the ability of a first protein competitively to inhibit the binding of a second protein to an antibody. It is, therefore, another aspect of the present invention to provide isolated polpeptide not only identical in sequence to those described with particularity herein, but also to provide isolated polypeptide ("cross-reactive proteins") that competitively inhibit the binding of antibodies to all or to a portion of various of the isolated polypeptides of the present invention. Such competitive inhibition can readily be determined using immunoassays well known in the art.

As discussed above, single nucleotide polymorphisms (SNPs) occur frequently in eukaryotic genomes, and the sequence determined from one individual of a species may differ from other allelic forms present within the population. Thus, polypeptides of the present invention are also inclusive of those encoded by an allelic variant of a nucleic acid molecule encoding a OSP. In this embodiment, it is preferred that the polypeptide be encoded by an allelic variant of a gene that encodes a polypeptide having the amino acid sequence selected from the group consisting of SEQ ID NO: 249-396. More preferred is that the polypeptide be encoded by an allelic variant of a gene that has the nucleic acid sequence selected from the group consisting of SEQ ID NO: 1-248.

Polypeptides of the present invention are also inclusive of derivative polypeptides encoded by a nucleic acid molecule according to the instant invention. In this embodiment, it is preferred that the polypeptide be a OSP. Also preferred are derivative polypeptides having an amino acid sequence selected from the group consisting of SEQ ID NO: 249-396 and which has been acetylated, carboxylated, phosphorylated, glycosylated, ubiquitinated or other PTMs. In another preferred embodiment, the derivative has been labeled with, e.g., radioactive isotopes such as $^{125}I$, $^{32}P$, $^{35}S$, and $^{3}H$. In another preferred embodiment, the derivative has been labeled with fluorophores, chemiluminescent agents, enzymes, and antiligands that can serve as specific binding pair members for a labeled ligand.

Polypeptide modifications are well known to those of skill and have been described in great detail in the scientific literature. Several particularly common modifications, glycosylation, lipid attachment, sulfation, gamma-carboxylation of glutamic acid residues, hydroxylation and ADP-ribosylation, for instance, are described in most basic texts, such as, for instance Creighton, *Protein Structure and Molecular Properties,* 2nd ed., W. H. Freeman and Company (1993). Many detailed reviews are available on this subject, such as, for example, those provided by Wold, in Johnson (ed.), *Post-translational Covalent Modification of Proteins,* pgs. 1-12, Academic Press (1983); Seifter et al., *Meth. Enzymol.* 182: 626-646 (1990) and Rattan et al., *Ann. N.Y. Acad. Sci.* 663: 48-62 (1992).

One may determine whether a polypeptide of the invention is likely to be post-translationally modified by analyzing the sequence of the polypeptide to determine if there are peptide motifs indicative of sites for post-translational modification. There are a number of computer programs that permit prediction of post-translational modifications. See, e.g., expasy with the extension .org of the world wide web (accessed November 11, 2002), which includes PSORT, for prediction of protein sorting signals and localization sites, SignalP, for prediction of signal peptide cleavage sites, MITOPROT and Predotar, for prediction of mitochondrial targeting sequences, NetOGlyc, for prediction of type O-glycosylation sites in mammalian proteins, big-PI Predictor and DGPI, for prediction of prenylation-anchor and cleavage sites, and NetPhos, for prediction of Ser, Thr and Tyr phosphorylation sites in eukaryotic proteins. Other computer programs, such as those included in GCG, also may be used to determine post-translational modification peptide motifs.

General examples of types of post-translational modifications include, but are not limited to: (Z)-dehydrobutyrine; 1-chondroitin sulfate-L-aspartic acid ester, 1'-glycosyl-L-tryptophan; 1'-phospho-L-histidine; 1-thioglycine; 2'-(S-L-cysteinyl)-L-histidine; 2'-[3-carboxamido(trimethylammonio)propyl]-L-histidine; 2'-alpha-mannosyl-L-tryptophan; 2-methyl-L-glutamine; 2-oxobutanoic acid; 2-pyrrolidone carboxylic acid; 3'-(1'-L-histidyl)-L-tyrosine; 3'-(8alpha-FAD)-L-histidine; 3'-(S-L-cysteinyl)-L-tyrosine; 3', 3",5'-triiodo-L-thyronine; 3'-4'-phospho-L-tyrosine; 3-hydroxy-L-proline; 3'-methyl-L-histidine; 3-methyl-L-lanthionine; 3'-phospho-L-histidine; 4'-(L-tryptophan)-L-tryptophyl quinone; 42 N-cysteinyl-glycosylphosphatidylinositolethanolamine; 43-(T-L-histidyl)-L-tyrosine; 4-hydroxy-L-arginine; 4-hydroxy-L-lysine; 4-hydroxy-L-proline; 5'-(N-6-L-lysine)-L-topaquinone; 5-hydroxy-L-lysine; 5-methyl-L-arginine; alpha-1-microglobulin-Ig alpha complex chromophore; bis-L-cysteinyl bis-L-histidino diiron disulfide; bis-L-cysteinyl-L-N3'-histidino-L-serinyl tetrairon' tetrasulfide; chondroitin sulfate D-glucuronyl-D-galactosyl-D-galactosyl-D-xylosyl-L-serine; D-alanine; D-allo-isoleucine; D-asparagine; dehydroalanine; dehydrotyrosine; dermatan 4-sulfate D-glucuronyl-D-galactosyl-D-galacto-syl-D-xylosyl-L-serine; D-glucuronyl-N-glycine; dipyrrolylmethanemethyl-L-cysteine; D-leucine; D-methionine; D-phenylalanine; D-serine; D-tryptophan; glycine amide; glycine oxazolecarboxylic acid; glycine thiazolecarboxylic acid; heme P450-bis-L-cysteine-L-tyrosine; heme-bis-L-cysteine; hemediol-L-aspartyl ester-L-glutamyl ester; hemediol-L-aspartyl ester-L-glutamyl ester-L-methionine sulfonium; heme-L-cysteine; heme-L-histidine; heparan sulfate D-glucuronyl-D-galactosyl-D-galactosyl-D-xylosyl-L-serine; heme P450-bis-L-cysteine-L-lysine; hexakis-L-cysteinyl hexairon hexasulfide; keratan sulfate D-glucuronyl-D-galactosyl-D-galactosyl-D-xylosyl-L-threonine; L oxoalanine-lactic acid; L phenyllactic acid; 1'-(8alpha-FAD)-L-histidine; L-2'.4',5'-topaquinone; L-3',4'-dihydroxyphenylalanine; L-3'.4'.5'-trihydroxyphenylalanine; L-4'-bromophenylalanine; L-6'-bromotryptophan; L-alanine amide; L-alanyl imidazolinone glycine; L-allysine; L-arginine amide; L-asparagine amide; L-aspartic 4-phosphoric anhydride; L-aspartic acid 1-amide; L-beta-methylthioaspartic acid; L-bromohistidine; L-citrulline; L-cysteine amide; L-cysteine glutathione disulfide; L-cysteine methyl disulfide; L-cysteine methyl ester, L-cysteine oxazolecarboxylic acid; L-cysteine oxazolinecarboxylic acid; L-cysteine persulfide; L-cysteine sulfenic acid; L-cysteine sulfinic acid; L-cysteine thiazolecarboxylic acid; L-cysteinyl homocitryl molybdenum-heptairon-nonasulfide; L-cysteinyl imidazolinone glycine; L-cysteinyl molybdopterin; L-cysteinyl molybdopterin guanine dinucleotide; L-cystine; L-erythro-beta-hydroxyasparagine; L-erythro-beta-hydroxyaspartic acid; L-gamma-carboxyglutamic acid; L-glutamic acid 1-amide; L-glutamic acid 5-methyl ester; L-glutamine amide; L-glutamyl 5-glycerylphosphorylethanolamine; L-histidine amide; L-isoglutamyl-polyglutamic acid; L-isoglutamyl-polyglycine; L-isoleucine amide; L-lanthionine; L-leucine amide; L-lysine amide; L-lysine thiazolecarboxylic acid; L-lysinoalanine; L-methionine amide; L-methionine sulfone; L-phenyalanine thiazolecarboxylic acid; L-phenylalanine amide; L-proline amide; L-selenocysteine; L-selenocysteinyl molybdopterin guanine dinucleotide; L-serine amide; L-serine thiazolecarboxylic acid; L-seryl imidazolinone glycine; L-T-bromophenylalanine; L-T-bromophenylalanine; L-threonine amide; L-thyroxine; L-tryptophan amide; L-tryptophyl quinone; L-tyrosine amide; L-valine amide; meso-lanthionine; N-L-glutamyl)-L-tyrosine; N-(L-isoaspartyl)-glycine; N-(L-isoaspartyl)-L-cysteine; N,N,N-trimethyl-L-alanine; N,N-dimethyl-L-proline; N2-acetyl-L-lysine; N2-succinyl-L-tryptophan; N4-(ADP-ribosyl)-L-asparagine; N4-glycosyl-L-asparagine; N4-hydroxymethyl-L-asparagine; N4-methyl-L-asparagine; N5-methyl-L-glutamine; N6-1-carboxyethyl-L-lysine; N6-(4-amino hydroxybutyl)-L-lysine; N6-(L-isoglutamyl)-L-lysine; N6-(phospho-5'-adenosine)-L-lysine; N6-(phospho-5'-guanosine)-L-tysine; N6,N6,N6-trimethyl-L-lysine; N6,N6-dimethyl-L-lysine; N6-acetyl-L-lysine; N6-biotinyl-L-lysine; N6-carboxy-L-lysine; N6-formyl-L-lysine; N6-glycyl-L-lysine; N6-lipoyl-L-lysine; N6-methyl-L-lysine; N6-methyl-N-6-poly(N-methyl-propylamine)-L-lysine; N6-mureinyl-L-lysine; N6-myristoyl-L-lysine; N6-palmitoyl-L-lysine; N6-pyridoxal phosphate-L-lysine; N6-pyruvic acid 2-iminyl-L-lysine; N6-retinal-L-lysine; N-acetylglycine; N-acetyl-L-glutamine; N-acetyl-L-alanine; N-acetyl-L-aspartic acid; N-acetyl-L-cysteine; N-acetyl-L-glutamic acid; N-acetyl-L-isoleucine; N-acetyl-L-methionine; N-acetyl-L-proline; N-acetyl-L-serine; N-acetyl-L-threonine; N-acetyl-L-tyrosine; N-acetyl-L-valine; N-alanyl-glycosylphosphatidylinositolethanolamine; N-asparaginyl-glycosylphosphatidylinositolethanolamine; N-aspartyl-glycosylphosphatidylinositolethanolamine; N-formylglycine; N-formyl-L-methionine; N-glycyl-glycosylphosphatidylinositolethanolamine; N-L-glutamyl-poly-L-glutamic acid; N-methylglycine; N-methyl-L-alanine; N-methyl-L-methionine; N-methyl-L-phenylalanine; N-myristoyl-glycine; N-palmitoyl-L-cysteine; N-pyruvic acid 2-iminyl-L-cysteine; N-pyruvic acid 2-iminyl-L-valine; N-seryl-glycosylphosphatidylinositolethanolamine; N-seryl-glycosyOSPhingolipidinositolethanolamine; O-(ADP-ribosyl)-L-serine; O-(phospho-5'-adenosine)-L-threonine; O-(phospho-5'-DNA)-L-serine; O-(phospho-5'-DNA)-L-threonine; O-(phospho-5'rRNA)-L-serine;

O-(phosphoribosyl dephospho-coenzyme A)-L-serine; O-(sn-1-glycerophosphoryl)-L-serine; O4'-(8alpha-FAD)-L-tyrosine; O4'-(phospho-5'-adenosine)-L-tyrosine; O4'-(phospho-5'-DNA)-L-tyrosine; O4'-(phospho-5'-RNA)-L-tyrosine; O4'-(phospho-5'-uridine)-L-tyrosine; O4-glycosyl-L-hydroxyproline; O4'-glycosyl-L-tyrosine; O4'-sulfo-L-tyrosine; O5-glycosyl-L-hydroxylysine; O-glycosyl-L-serine; O-glycosyl-L-threonine; omega-N-(ADP-ribosyl)-L-arginine; omega-N-omega-N'-dimethyl-L-arginine; omega-N-methyl-L-arginine; omega-N-omega-N'-dimethyl-L-arginine; omega-N-phospho-L-arginine; O'octanoyl-L-serine; O-palmitoyl-L-serine; O-palmitoyl-L-threonine; O-phospho-L-serine; O-phospho-L-threonine; O-phospho-pantetheine-L-serine; phycoerythrobilin-bis-L-cysteine; phycourobilin-bis-L-cysteine; pyrroloquinoline quinone; pyruvic acid; S hydroxycinnamyl-L-cysteine; S-(2-aminovinyl)methyl-D-eysteine; S-(2-aminovinyl)-D-cysteine; S-(6-FW-L-cysteine; S-(8alpha-FAD)-L-cysteine; S-(ADP-ribosyl)-L-cysteine; S-(L-isoglutamyl)-L-cysteine; S-12-hydroxyfarnesyl-L-cysteine; S-acetyl-L-cysteine; S-diacylglycerol-L-cysteine; S-diphytanylglycerot diether-L-cysteine; S-farnesyl-L-cysteine; S-geranylgeranyl-L-cysteine; S-glycosyl-L-cysteine; S-glycyl-L-cysteine; S-methyl-L-cysteine; S-nitrosyl-L-cysteine; S-palmitoyl-L-cysteine; S-phospho-L-cysteine; S-phycobiliviolin-L-cysteine; S-phycocyanobilin-L-cysteine; S-phycoerythrobilin-L-cysteine; S-phytochromobilin-L-cysteine; S-selenyl-L-cysteine; S-sulfo-L-cysteine; tetrakis-L-cysteinyl diiron disulfide; tetrakis-L-cysteinyl iron; tetrakis-L-cysteinyl tetrairon tetrasulfide; trans-2,3-cis 4-dihydroxy-L-proline; tris-L-cysteinyl triiron tetrasulfide; tris-L-cysteinyl triiron trisulfide; tris-L-cysteinyl-L-aspartato tetrairon tetrasulfide; tris-L-cysteinyl-L-cysteine persulfido-bis-L-glutamato-L-histidino tetrairon disulfide trioxide; tris-L-cysteinyl-L-N3'-histidino tetrairon tetrasulfide; tris-L-cysteinyl-L-N3'-histidino tetrairon tetrasulfide; and tris-L-cysteinyl-L-serinyl tetrairon tetrasulfide.

Additional examples of PTMs may be found in web sites such as the Delta Mass database based on Krishna, R. G. and F. Wold (1998). Posttrnslational Modifications. Proteins—Analysis and Design. R. H. Angeletti. San Diego, Academic Press. 1: 121-206; Methods in Enzymology, 193, J. A. McClosky (ed) (1990), pages 647-660; Methods in Protein Sequence Analysis edited by Kazutomo Imahori and Fumio Sakiyama, Plenum Press, (1993) "Post-translational modifications of proteins" R. G. Krishna and F. Wold pages 167-172; "GlycoSuiteDB: a new curated relational database of glycoprotein glycan structures and their biological sources" Cooper et al. Nucleic Acids Res. 29; 332-335 (2001) "O-GLYCBASE version 4.0: a revised database of O-glycosylated proteins" Gupta et al. Nucleic Acids Research, 27: 370-372 (1999); and "PhosphoBase, a database of phosphorylation sites: release 2.0.", Kreegipuu et al. Nucleic Acids Res 27(1):237-239 (1999) see also, WO 02/21139A2, the disclosure of which is incorporated herein by reference in its entirety.

Tumorigenesis is often accompanied by alterations in the post-translational modifications of proteins. Thus, in another embodiment, the invention provides polypeptides from cancerous cells or tissues that have altered post-translational modifications compared to the post-translational modifications of polypeptides from normal cells or tissues. A number of altered post-translational modifications are known. One common alteration is a change in phosphorylation state, wherein the polypeptide from the cancerous cell or tissue is hyperphosphorylated or hypophosphorylated compared to the polypeptide from a normal tissue, or wherein the polypeptide is phosphorylated on different residues than the polypeptide from a normal cell. Another common alteration is a change in glycosylation state, wherein the polypeptide from the cancerous cell or tissue has more or less glycosylation than the polypeptide from a normal tissue, and/or wherein the polypeptide from the cancerous cell or tissue has a different type of glycosylation than the polypeptide from a noncancerous cell or tissue. Changes in glycosylation may be critical because carbohydrate-protein and carbohydrate-carbohydrate interactions are important in cancer cell progression, dissemination and invasion See, e.g., Barchi, Curr. Pharm. Des. 6: 485-501 (2000), Verma, Cancer Biochem. Biophys. 14: 151-162 (1994) and Dennis et al., Bioessays 5: 412-421 (1999).

Another post-translational modification that may be altered in cancer cells is prenylation. Prenylation is the covalent attachment of a hydrophobic prenyl group (either farnesyl or geranylgeranyl) to a polypeptide. Prenylation is required for localizing a protein to a cell membrane and is often required for polypeptide function. For instance, the Ras superfamily of GTPase signalling proteins must be prenylated for function in a cell. See, e.g., Prendergast et al., Semin. Cancer Biol. 10: 443452 (2000) and Khwaja et al., Lancet 355: 741-744 (2000).

Other post-translation modifications that may be altered in cancer cells include, without limitation, polypeptide methylation, acetylation, arginylation or racemization of amino acid residues. In these cases, the polypeptide from the cancerous cell may exhibit either increased or decreased amounts of the post-translational modification compared to the corresponding polypeptides from noncancerous cells.

Other polypeptide alterations in cancer cells include abnormal polypeptide cleavage of proteins and aberrant protein-protein interactions. Abnormal polypeptide cleavage may be cleavage of a polypeptide in a cancerous cell that does not usually occur in a normal cell, or a lack of cleavage in a cancerous cell, wherein the polypeptide is cleaved in a normal cell. Aberrant protein-protein interactions may be either covalent cross-linking or non-covalent binding between proteins that do not normally bind to each other. Alternatively, in a cancerous cell, a protein may fail to bind to another protein to which it is bound in a noncancerous cell. Alterations in cleavage or in protein-protein interactions may be due to over- or underproduction of a polypeptide in a cancerous cell compared to that in a normal cell, or may be due to alterations in post-translational modifications (see above) of one or more proteins in the cancerous cell. See, e.g., Henschen-Edman, Ann. N.Y. Acad. Sci. 936: 580-593 (2001).

Alterations in polypeptide post-translational modifications, as well as changes in polypeptide cleavage and protein-protein interactions, may be determined by any method known in the art. For instance, alterations in phosphorylation may be determined by using anti-phosphoserine, anti-phosphothreonine or anti-phosphotyrosine antibodies or by amino acid analysis. Glycosylation alterations may be determined using antibodies specific for different sugar residues, by carbohydrate sequencing, or by alterations in the size of the glycoprotein, which can be determined by, e.g., SDS polyacrylamide gel electrophoresis (PAGE). Other alterations of post-translational modifications, such as prenylation, racemization, methylation, acetylation and arginylation, may be determined by chemical analysis, protein sequencing, amino acid analysis, or by using antibodies specific for the particular post-translational modifications. Changes in protein-protein interactions and in polypeptide cleavage may be analyzed by any method known in the art including, without limitation, non-denaturing PAGE (for non-covalent protein-protein interactions), SDS PAGE (for covalent protein-protein interactions and protein cleavage), chemical cleavage, protein sequencing or immunoassays.

In another embodiment, the invention provides polypeptides that have been post-translationally modified. In one embodiment, polypeptides may be modified enzymatically or chemically, by addition or removal of a post-translational modification. For example, a polypeptide may be glycosylated or deglycosylated enzymatically. Similarly, polypeptides may be phosphorylated using a purified kinase, such as a MAP kinase (e.g, p38, ERK, or JNK) or a tyrosine kinase (e.g., Src or erbB2). A polypeptide may also be modified through synthetic chemistry. Alternatively, one may isolate the polypeptide of interest from a cell or tissue that expresses the polypeptide with the desired post-translational modification. In another embodiment, a nucleic acid molecule encoding the polypeptide of interest is introduced into a host cell that is capable of post-transiationally modifying the encoded polypeptide in the desired fashion. If the polypeptide does not contain a motif for a desired post translational modification, one may alter the post-translational modification by mutating the nucleic acid sequence of a nucleic acid molecule encoding the polypeptide so that it contains a site for the desired post-translational modification. Amino acid sequences that may be post-transiationally modified are known in the art. See, e.g., the programs described above on the website expasy with the extension .org of the world wide web. The nucleic acid molecule may also be introduced into a host cell that is capable of post-translationally modifying the encoded polypeptide. Similarly, one may delete sites that are post-translationally modified by either mutating the nucleic acid sequence so that the encoded polypeptide does not contain the post-translational modification motif, or by introducing the native nucleic acid molecule into a host cell that is not capable of post-translationally modifying the encoded polypeptide.

It will be appreciated, as is well known and as noted above, that polypeptides are not always entirely linear. For instance, polypeptides may be branched as a result of ubiquitination, and they may be circular, with or without branching, generally as a result of posttranslation events, including natural processing event and events brought about by human manipulation which do not occur naturally. Circular, branched and branched circular polypeptides may be synthesized by non-translation natural process and by entirely synthetic methods, as well. Modifications can occur anywhere in a polypeptide, including the peptide backbone, the amino acid side-chains and the amino or carboxyl termini. In fact, blockage of the amino or carboxyl group in a polypeptide, or both, by a covalent modification, is common in naturally occurring and synthetic polypeptides and such modifications may be present in polypeptides of the present invention, as well. For instance, the amino terminal residue of polypeptides made in *E. coli*, prior to proteolytic processing, almost invariably will be N-formylmethionine.

Useful post-synthetic (and post-translational) modifications include conjugation to detectable labels, such as fluorophores. A wide variety of amine-reactive and thiol-reactive fluorophore derivatives have been synthesized that react under nondenaturing conditions with N-terminal amino groups and epsilon amino groups of lysine residues, on the one hand, and with free thiol groups of cysteine residues, on the other.

Kits are available commercially that permit conjugation of proteins to a variety of amine-reactive or thiol-reactive fluorophores: Molecular Probes, Inc. (Eugene, Oreg., USA), e.g., offers kits for conjugating proteins to Alexa Fluor 350, Alexa Fluor 430, Fluorescein-EX, Alexa Fluor 488, Oregon Green 488, Alexa Fluor 532, Alexa Fluor 546, Alexa Fluor 546, Alexa Fluor 568, Alexa Fluor 594, and Texas Red-X.

A wide variety of other amine-reactive and thiol-reactive fluorophores are available commercially (Molecular Probes, Inc., Eugene, Oreg., USA), including Alexa Fluor® 350, Alexa Fluor® 488, Alexa Fluor® 532, Alexa Fluor® 546, Alexa Fluor® 568, Alexa Fluor® 594, Alexa Fluor® 647 (monoclonal antibody labeling kits available from Molecular Probes, Inc., Eugene, Oreg., USA), BODIPY dyes, such as BODIPY 493/503, BODIPY FL, BODIPY R6G, BODIPY 530/550, BODIPY TMR, BODIPY 558/568, BODIPY 558/568, BODIPY 564/570, BODIPY 576/589, BODIPY 581/591, BODIPY TR, BODIPY 630/650, BODIPY 650/665, Cascade Blue, Cascade Yellow, Dansyl, lissamine rhodamine B, Marina Blue, Oregon Green 488, Oregon Green 514, Pacific Blue, rhodamine 6G, rhodamine green, rhodamine red, tetramethylrhodamine, Texas Red (available from Molecular Probes, Inc., Eugene, Oreg., USA).

The polypeptides of the present invention can also be conjugated to fluorophores, other proteins, and other macromolecules, using bifunctional linking reagents. Common homobifunctional reagents include, e.g., APG, AEDP, BASED, BMB, BMDB, BMH, BMOE, BM[PEO]3, BM[PEO]4, BS3, BSOCOES, DFDNB, DMA, DMP, DMS, DPDPB, DSG, DSP (Lomant's Reagent), DSS, DST, DTBP, DTME, DTSSP, EGS, HBVS, Sulfo-BSOCOES, Sulfo-DST, Sulfo-EGS (all available from Pierce, Rockford, Ill., USA); common heterobifunctional cross-linkers include ABH, AMAS, ANB-NOS, APDP, ASBA, BMPA, BMPH, BMPS, EDC, EMCA, EMCH, EMCS, KMUA, KMUH, GMBS, LC-SMCC, LC-SPDP, MBS, M2C2H, MPBH, MSA, NHS-ASA, PDPH, PMPI, SADP, SAED, SAND, SANPAH, SASD, SATP, SBAP, SFAD, SIA, SIAB, SMCC, SMPB, SMPH, SMPT, SPDP, Sulfo-EMCS, Sulfo-GMBS, Sulfo-HSAB, Sulfo-KMUS, Sulfo-LC-SPDP, Sulfo-MBS, Sulfo-NHS-LC-ASA, Sulfo-SADP, Sulfo-SANPAH, Sulfo-SIAB, Sulfo-SMCC, Sulfo-SMPB, Sulfo-LC-SMPT, SVSB, TFCS (all available Pierce, Rockford, Ill., USA).

Polypeptides of the present invention, including full length polypeptides, fragments and fusion proteins, can be conjugated, using such cross-linking reagents, to fluorophores that are not amine- or thiol-reactive. Other labels that usefully can be conjugated to polypeptides of the present invention include radioactive labels, echosonographic contrast reagents, and MRI contrast agents.

Polypeptides of the present invention, including full length polypeptide, fragments and fusion proteins, can also usefully be conjugated using cross-linking agents to carrier proteins, such as KLH, bovine thyroglobulin, and even bovine serum albumin (BSA), to increase immunogenicity for raising anti-OSP antibodies.

Polypeptides of the present invention, including full length polypeptide, fragments and fusion proteins, can also usefully be conjugated to polyethylene glycol (PEG); PEGylation increases the serum half life of proteins administered intravenously for replacement therapy. Delgado et al., *Crit. Rev. Ther. Drug Carrier Syst.* 9(3-4): 249-304 (1992); Scott et al., *Curr. Pharm. Des.* 4(6): 423-38 (1998); DeSantis et al., *Curr. Opin. Biotechnol.* 10(4): 324-30 (1999). PEG monomers can be attached to the protein directly or through a linker, with PEGylation using PEG monomers activated with tresyl chloride (2,2,2-trifluoroethanesulphonyl chloride) permitting direct attachment under mild conditions.

Polypeptides of the present invention are also inclusive of analogs of a polypeptide encoded by a nucleic acid molecule according to the instant invention. In a preferred embodiment, this polypeptide is a OSP. In a more preferred embodiment, this polypeptide is derived from a polypeptide having part or all of the amino acid sequence of SEQ ID NO: 249-396. Also preferred is an analog polypeptide comprising one or more substitutions of non-natural amino acids or non-native inter-residue bonds compared to the naturally occurring polypeptide. In one embodiment, the analog is structurally similar to a OSP, but one or more peptide linkages is replaced by a linkage selected from the group consisting of —CH$_2$NH—, —CH$_2$S—, —CH$_2$—CH$_2$—, CH=CH-(cis and trans), —COCH$_2$—, —CH(OH)CH$_2$— and —CH$_2$SO—. In another embodiment, the analog comprises substitution of one or more amino acids of a OSP with a D-amino acid of the same type or other non-natural amino acid in order to generate more stable peptides. D-amino acids can readily be incorporated during chemical peptide synthesis: peptides assembled from D-amino acids are more resistant to proteolytic attack; incorporation of D-amino acids can also be used to confer specific three-dimensional conformations on the peptide. Other amino acid analogues commonly added during chemical synthesis include ornithine, norleucine, phosphorylated amino acids (typically phosphoserine, phosphothreonine, phosphotyrosine), L-malonyltyrosine, a non-hydrolyzable analog of phosphotyrosine (see, e.g., Kole et al, *Biochem. Biophys. Res. Com.* 209: 817-821 (1995)), and various halogenated phenylalanine derivatives.

Non-natural amino acids can be incorporated during solid phase chemical synthesis or by recombinant techniques, although the former is typically more common. Solid phase chemical synthesis of peptides is well established in the art. Procedures are described, inter alia, in Chan et al. (eds.), *Fmoc Solid Phase Peptide Synthesis: A Practical Approach* (Practical Approach Series), Oxford Univ. Press (March 2000); Jones, *Amino Acid and Peptide Synthesis* (Oxford Chemistry Primers, No 7), Oxford Univ. Press (1992); and Bodanszky, *Principles of Peptide Synthesis* (Springer Laboratory), Springer Verlag (1993).

Amino acid analogues having detectable labels are also usefully incorporated during synthesis to provide derivatives and analogs. Biotin, for example can be added using biotinoyl-(9-fluorenylmethoxycarbonyl)-L-lysine (FMOC biocytin) (Molecular Probes, Eugene, Oreg., USA). Biotin can also be added enzymatically by incorporation into a fusion protein of a *E. coli* BirA substrate peptide. The FMOC and tBOC derivatives of dabcyl-L-lysine (Molecular Probes, Inc., Eugene, Oreg., USA) can be used to incorporate the dabcyl chromophore at selected sites in the peptide sequence during synthesis. The aminonaphthalene derivative EDANS, the most common fluorophore for pairing with the dabcyl quencher in fluorescence resonance energy transfer (FRET) systems, can be introduced during automated synthesis of peptides by using EDANS-FMOC-L-glutamic acid or the corresponding tBOC derivative (both from Molecular Probes, Inc., Eugene, Oreg., USA). Tetramethylrhodamine fluorophores can be incorporated during automated FMOC synthesis of peptides using (FMOC)-TMR-L-lysine (Molecular Probes, Inc. Eugene, Oreg., USA).

Other useful amino acid analogues that can be incorporated during chemical synthesis include aspartic acid, glutamic acid, lysine, and tyrosine analogues having allyl side-chain protection (Applied Biosystems, Inc., Foster City, Calif., USA); the allyl side chain permits synthesis of cyclic, branched-chain, sulfonated, glycosylated, and phosphorylated peptides.

A large number of other FMOC-protected non-natural amino acid analogues capable of incorporation during chemical synthesis are available commercially, including, e.g., Fmoc-2-aminobicyclo[2.2.1]heptane-2-carboxylic acid, Fmoc-3-endo-aminobicyclo[2.2.1]heptane-2-endo-carboxylic acid, Fmoc-3-exo-aminobicyclo[2.2.1]heptane-2-exo-carboxylic acid, Fmoc-3-endo-aminobicyclo[2.2.1]hept-5-ene-2-endo-carboxylic acid, Fmoc-3-exo-amino-bicyclo[2.2.1]hept-5-ene-2-exo-carboxylic acid, Fmoc-cis-2-amino-1-cyclohexanecarboxylic acid, Fmoc-trans-2-amino-1-cyclohexanecarboxylic acid, Fmoc-1-amino-1-cyclopentanecarboxylic acid, Fmoc-cis-2-amino-1-cyclopentanecarboxylic acid, Fmoc-1-amino-1-cyclopropanecarboxylic acid, Fmoc-D-2-amino-4-(ethylthio)butyric acid, Fmoc-L-2-amino-4-(ethylthio) butyric acid, Fmoc-L-buthionine, Fmoc-5-methyl-L-Cysteine, Fmoc-2-aminobenzoic acid (anthranillic acid), Fmoc-3-aminobenzoic acid, Fmoc-4-aminobenzoic acid, Fmoc-2-aminobenzophenone-2'-carboxylic acid, Fmoc-N-(4-aminobenzoyl)-β-alanine, Fmoc-2-amino-4,5-dimethoxybenzoic acid, Fmoc-4-aminohippuric acid, Fmoc-2-amino-3-hydroxybenzoic acid, Fmoc-2-amino-5-hydroxybenzoic acid, Fmoc-3-amino-4-hydroxybenzoic acid, Fmoc-4-amino-3-hydroxybenzoic acid, Fmoc-4-amino-2-hydroxybenzoic acid, Fmoc-5-amino-2-hydroxybenzoic acid, Fmoc-2-amino-3-methoxybenzoic acid, Fmoc-4-amino-3-methoxybenzoic acid, Fmoc-2-amino-3-methylbenzoic acid, Fmoc-2-amino-5-methylbenzoic acid, Fmoc-2-amino-6-methylbenzoic acid, Fmoc-3-amino-2-methylbenzoic acid, Fmoc-3-amino-4-methylbenzoic acid, Fmoc-4-amino-3-methylbenzoic acid, Fmoc-3-amino-2-naphtoic acid, Fmoc-D,L-3-amino-3-phenylpropionic acid, Fmoc-L-Methyldopa, Fmoc-2-amino-4,6-dimethyl-3-pyridinecarboxylic acid, Fmoc-D,L-amino-2-thiophenacetic acid, Fmoc-4-(carboxymethyl)piperazine, Fmoc-4-carboxypiperazine, Fmoc-4-(carboxymethyl)homopiperazine, Fmoc-4-phenyl-4-piperidinecarboxylic acid, Fmoc-L-1,2,3, 4-tetrahydronorharman-3-carboxylic acid, Fmoc-L-thiazolidine-4-carboxylic acid, all available from The Peptide Laboratory (Richmond, Calif., USA).

Non-natural residues can also be added biosynthetically by engineering a suppressor tRNA, typically one that recognizes the UAG stop codon, by chemical aminoacylation with the desired unnatural amino acid. Conventional site-directed mutagenesis is used to introduce the chosen stop codon UAG at the site of interest in the protein gene. When the acylated suppressor tRNA and the mutant gene are combined in an in vitro transcription/translation system, the unnatural amino acid is incorporated in response to the UAG codon to give a protein containing that amino acid at the specified position. Liu et al., *Proc. Natl. Acad. Sci. USA* 96(9): 4780-5 (1999); Wang et al, *Science* 292(5516): 498-500 (2001).

Fusion Proteins

Another aspect of the present invention relates to the fusion of a polypeptide of the present invention to heterologous polypeptides. In a preferred embodiment, the polypeptide of the present invention is a OSP. In a more preferred embodiment, the polypeptide of the present invention that is fused to a heterologous polypeptide comprises part or all of the amino acid sequence of SEQ ID NO: 249-396, or is a mutein, homologous polypeptide, analog or derivative thereof. In an even more preferred embodiment, the fusion protein is encoded by a nucleic acid molecule comprising all or part of the nucleic acid sequence of SEQ ID NO: 1-248, or comprises all or part of a nucleic acid sequence that selectively hybridizes or is homologous to a nucleic acid molecule comprising a nucleic acid sequence of SEQ ID NO: 1-248.

The fusion proteins of the present invention will include at least one fragment of a polypeptide of the present invention, which fragment is at least 6, typically at least 8, often at least 15, and usefully at least 16, 17, 18, 19, or 20 amino acids long.

The fragment of the polypeptide of the present to be included in the fusion can usefully be at least 25 amino acids long, at least 50 amino acids long, and can be at least 75, 100, or even 150 amino acids long. Fusions that include the entirety of a polypeptide of the present invention have particular utility.

The heterologous polypeptide included within the fusion protein of the present invention is at least 6 amino acids in length, often at least 8 amino acids in length, and preferably at least 15, 20, or 25 amino acids in length. Fusions that include larger polypeptides, such as the IgG Fc region, and even entire proteins (such as GFP chromophore-containing proteins) are particularly useful.

As described above in the description of vectors and expression vectors of the present invention, which discussion is incorporated here by reference in its entirety, heterologous polypeptides to be included in the fusion proteins of the present invention can usefully include those designed to facilitate purification and/or visualization of recombinantly-expressed proteins. See, e.g., Ausubel, Chapter 16, (1992), supra. Although purification tags can also be incorporated into fusions that are chemically synthesized, chemical synthesis typically provides sufficient purity that further purification by HPLC suffices; however, visualization tags as above described retain their utility even when the protein is produced by chemical synthesis, and when so included render the fusion proteins of the present invention useful as directly detectable markers of the presence of a polypeptide of the invention.

As also discussed above, heterologous polypeptides to be included in the fusion proteins of the present invention can usefully include those that facilitate secretion of recombinantly expressed proteins into the periplasmic space or extracellular milieu for prokaryotic hosts or into the culture medium for eukaryotic cells through incorporation of secretion signals and/or leader sequences. For example, a $His^6$ tagged protein can be purified on a Ni affinity column and a GST fusion protein can be purified on a glutathione affinity column. Similarly, a fusion protein comprising the Fc domain of IgG can be purified on a Protein A or Protein G column and a fusion protein comprising an epitope tag such as myc can be purified using an immunoaffinity column containing an anti-c-myc antibody. It is preferable that the epitope tag be separated from the protein encoded by the essential gene by an enzymatic cleavage site that can be cleaved after purification. See also the discussion of nucleic acid molecules encoding fusion proteins that may be expressed on the surface of a cell.

Other useful fusion proteins of the present invention include those that permit use of the polypeptide of the present invention as bait in a yeast two-hybrid system. See Bartel et al. (eds.), *The Yeast Two-Hybrid System*, Oxford University Press (1997); Zhu et al., *Yeast Hybrid Technologies*, Eaton Publishing (2000); Fields et al., *Trends Genet.* 10(8): 286-92 (1994); Mendelsohn et al., *Curr. Opin. Biotechnol.* 5(5): 482-6 (1994); Luban et al., *Curr. Opin. Biotechnol.* 6(1): 59-64 (1995); Allen et al., *Trends Biochem. Sci.* 20(12): 511-6 (1995); Drees, *Curr. Opin. Chem. Biol.* 3(1): 64-70 (1999); Topcu et al., *Pharm. Res.* 17(9): 1049-55 (2000); Fashena et al., *Gene* 250(1-2): 1-14 (2000); Colas et al., *Nature* 380, 548-550 (1996); Norman, T. et al., *Science* 285, 591-595 (1999); Fabbrizio et al., *Oncogene* 18, 43574363 (1999); Xu et al., *Proc Natl Acad Sci USA*. 94, 12473-12478 (1997); Yang, et al., *Nuc. Acids Res.* 23, 1152-1156 (1995); Kolonin et al., *Proc Natl Acad Sci USA* 95, 14266-14271 (1998); Cohen et al., *Proc Natl Acad Sci USA* 95, 14272-14277 (1998); Uetz, et al. *Nature* 403, 623-627(2000); Ito, et al., *Proc Natl Acad Sci USA* 98, 45694574 (2001). Typically, such fusion is to either *E. coli* LexA or yeast GAL4 DNA binding domains. Related bait plasmids are available that express the bait fused to a nuclear localization signal.

Other useful fusion proteins include those that permit display of the encoded polypeptide on the surface of a phage or cell, fusions to intrinsically fluorescent proteins, such as green fluorescent protein (GFP), and fusions to the IgG Fc region, as described above.

The polypeptides of the present invention can also usefully be fused to protein toxins, such as *Pseudomonas* exotoxin A, diphtheria toxin, shiga toxin A, anthrax toxin lethal factor, ricin, in order to effect ablation of cells that bind or take up the proteins of the present invention.

Fusion partners include, inter alia, myc, hemagglutinin (HA), GST, immunoglobulins, β-galactosidase, biotin trpE, protein A, β-lactamase, α-amylase, maltose binding protein, alcohol dehydrogenase, polyhistidine (for example, six histidine at the amino and/or carboxyl terminus of the polypeptide), lacZ, green fluorescent protein (GFP), yeast α mating factor, GAL4 transcription activation or DNA binding domain, luciferase, and serum proteins such as ovalbumin, albumin and the constant domain of IgG. See, e.g., Ausubel (1992), supra and Ausubel (1999), supra. Fusion proteins may also contain sites for specific enzymatic cleavage, such as a site that is recognized by enzymes such as Factor XIII, trypsin, pepsin, or any other enzyme known in the art Fusion proteins will typically be made by either recombinant nucleic acid methods, as described above, chemically synthesized using techniques well known in the art (e.g., a Merrifield synthesis), or produced by chemical cross-linking.

Another advantage of fusion proteins is that the epitope tag can be used to bind the fusion protein to a plate or column through an affinity linkage for screening binding proteins or other molecules that bind to the OSP.

As further described below, the polypeptides of the present invention can readily be used as specific immunogens to raise antibodies that specifically recognize polypeptides of the present invention including OSPs and their allelic variants and homologues. The antibodies, in turn, can be used, inter alia, specifically to assay for the polypeptides of the present invention, particularly OSPs, e.g. by ELISA for detection of protein fluid samples, such as serum, by immunohistochemistry or laser scanning cytometry, for detection of protein in tissue samples, or by flow cytometry, for detection of intracellular protein in cell suspensions, for specific antibody-mediated isolation and/or purification of OSPs, as for example by immunoprecipitation, and for use as specific agonists or antagonists of OSPs.

One may determine whether polypeptides of the present invention including OSPs, muteins, homologous proteins or allelic variants or fusion proteins of the present invention are functional by methods known in the art. For instance, residues that are tolerant of change while retaining function can be identified by altering the polypeptide at known residues using methods known in the art, such as alanine scanning mutagenesis, Cunningham et al., *Science* 244(4908): 1081-5 (1989); transposon linker scanning mutagenesis, Chen et al., *Gene* 263(1-2): 39-48 (2001); combinations of homolog- and alanine-scanning mutagenesis, Jin et al., *J. Mol. Biol.* 226(3): 851-65 (1992); combinatorial alanine scanning, Weiss et al., *Proc. Natl. Acad. Sci USA* 97(16): 89504 (2000), followed by functional assay. Transposon linker scanning kits are available commercially (New England Biolabs, Beverly, Mass., USA, catalog. no. E7-102S; EZ:TN™ In-Frame Linker Insertion Kit, catalogue no. EZI04KN, (Epicentre Technologies Corporation, Madison, Wis., USA).

Purification of the polypeptides or fusion proteins of the present invention is well known and within the skill of one having ordinary skill in the art. See, e.g., Scopes, *Protein Purification,* 2d ed. (1987). Purification of recombinantly expressed polypeptides is described above. Purification of chemically-synthesized peptides can readily be effected, e.g., by HPLC.

Accordingly, it is an aspect of the present invention to provide the isolated polypeptides or fusion proteins of the present invention in pure or substantially pure form in the presence of absence of a stabilizing agent. Stabilizing agents include both proteinaceous and non-proteinaceous material and are well known in the art. Stabilizing agents, such as albumin and polyethylene glycol (PEG) are known and are commercially available.

Although high levels of purity are preferred when the isolated polypeptide or fusion protein of the present invention are used as therapeutic agents, such as in vaccines and replacement therapy, the isolated polypeptides of the present invention are also useful at lower purity. For example, partially purified polypeptides of the present invention can be used as immunogens to raise antibodies in laboratory animals.

In a preferred embodiment, the purified and substantially purified polypeptides of the present invention are in compositions that lack detectable ampholytes, acrylamide monomers, bis-acrylamide monomers, and polyacrylamide.

The polypeptides or fusion proteins of the present invention can usefully be attached to a substrate. The substrate can be porous or solid, planar or non-planar; the bond can be covalent or noncovalent. For example, the peptides of the invention may be stabilized by covalent linkage to albumin. See, U.S. Pat. No. 5,876,969, the contents of which are hereby incorporated in its entirety.

For example, the polypeptides or fusion proteins of the present invention can usefully be bound to a porous substrate, commonly a membrane, typically comprising nitrocellulose, polyvinylidene fluoride (PVDF), or cationically derivatized, hydrophilic PVDF; so bound, the polypeptides or fusion proteins of the present invention can be used to detect and quantify antibodies, e.g. in serum, that bind specifically to the immobilized polypeptide or fusion protein of the present invention.

As another example, the polypeptides or fusion proteins of the present invention can usefully be bound to a substantially nonporous substrate, such as plastic, to detect and quantify antibodies, e.g. in serum, that bind specifically to the immobilized protein of the present invention. Such plastics include polymethylacrylic, polyethylene, polypropylene, polyacrylate, polymethylmethacrylate, polyvinylchloride, polytetrafluoroethylene, polystyrene, polycarbonate, polyacetal, polysulfone, celluloseacetate, cellulosenitrate, nitrocellulose, or mixtures thereof; when the assay is performed in a standard microtiter dish, the plastic is typically polystyrene.

The polypeptides and fusion proteins of the present invention can also be attached to a substrate suitable for use as a surface enhanced laser desorption ionization source; so attached, the polypeptide or fusion protein of the present invention is useful for binding and then detecting secondary proteins that bind with sufficient affinity or avidity to the surface-bound polypeptide or fusion protein to indicate biologic interaction there between. The polypeptides or fusion proteins of the present invention can also be attached to a substrate suitable for use in surface plasmon resonance detection; so attached, the polypeptide or fusion protein of the present invention is useful for binding and then detecting secondary proteins that bind with sufficient affinity or avidity to the surface-bound polypeptide or fusion protein to indicate biological interaction there between.

Alternative Transcripts

In another aspect, the present invention provides splice variants of genes and proteins encoded thereby. The identification of a novel splice variant which encodes an amino acid sequence with a novel region can be targeted for the generation of reagents for use in detection and/or treatment of cancer. The novel amino acid sequence may lead to a unique protein structure, protein subcellular localization, biochemical processing or function of the splice variant. This information can be used to directly or indirectly facilitate the generation of additional or novel therapeutics or diagnostics. The nucleotide sequence in this novel splice variant can be used as a nucleic acid probe for the diagnosis and/or treatment of cancer.

Specifically, the newly identified sequences may enable the production of new antibodies or compounds directed against the novel region for use as a therapeutic or diagnostic. Alternatively, the newly identified sequences may alter the biochemical or biological properties of the encoded protein in such a way as to enable the generation of improved or different therapeutics targeting this protein.

Antibodies

In another aspect, the invention provides antibodies, including fragments and derivatives thereof, that bind specifically to polypeptides encoded by the nucleic acid molecules of the invention. In a preferred embodiment, the antibodies are specific for a polypeptide that is a OSP, or a fragment, mutein, derivative, analog or fusion protein thereof. In a more preferred embodiment, the antibodies are specific for a polypeptide that comprises SEQ ID NO: 249-396, or a fragment, mutein, derivative, analog or fusion protein thereof.

The antibodies of the present invention can be specific for linear epitopes, discontinuous epitopes, or conformational epitopes of such proteins or protein fragments, either as present on the protein in its native conformation or, in some cases, as present on the proteins as denatured, as, e.g., by solubilization in SDS. New epitopes may be also due to a difference in post translational modifications (PTMs) in disease versus normal tissue. For example, a particular site on a OSP may be glycosylated in cancerous cells, but not glycosylated in normal cells or vis versa. In addition, alternative splice forms of a OSP may be indicative of cancer. Differential degradation of the C or N-terminus of a OSP may also be a marker or target for anticancer therapy. For example, an OSP may be N-terminal degraded in cancer cells exposing new epitopes to which antibodies may selectively bind for diagnostic or therapeutic uses.

As is well known in the art, the degree to which an antibody can discriminate as among molecular species in a mixture will depend, in part, upon the conformational relatedness of the species in the mixture; typically, the antibodies of the present invention will discriminate over adventitious binding to non-OSP polypeptides by at least two-fold, more typically by at least 5-fold, typically by more than 10-fold, 25-fold, 50-fold, 75-fold, and often by more than 100-fold, and on occasion by more than 500-fold or 1000-fold. When used to detect the proteins or protein fragments of the present invention, the antibody of the present invention is sufficiently specific when it can be used to determine the presence of the polypeptide of the present invention in samples derived from human ovarian.

Typically, the affinity or avidity of an antibody (or antibody multimer, as in the case of an IgM pentamer) of the present invention for a protein or protein fragment of the present invention will be at least about $1 \times 10^{-6}$ molar (M), typically at least about $5\times10^{-7}$ M, $1\times10^{-7}$ M, with affinities and avidities of at least $1\times10^{-8}$ M, $5\times10^{-9}$ M, $1\times10^{-10}$ M and up to $1\times10^{-13}$ M proving especially useful.

The antibodies of the present invention can be naturally occurring forms, such as IgG, IgM, IgD, IgE, IgY, and IgA, from any avian, reptilian, or mammalian species.

Human antibodies can, but will infrequently, be drawn directly from human donors or human cells. In such case, antibodies to the polypeptides of the present invention will typically have resulted from fortuitous immunization, such as autoimmune immunization, with the polypeptide of the present invention. Such antibodies will typically, but will not invariably, be polyclonal. In addition, individual polyclonal antibodies may be isolated and cloned to generate monoclonals.

Human antibodies are more frequently obtained using transgenic animals that express human immunoglobulin genes, which transgenic animals can be affirmatively immunized with the protein immunogen of the present invention. Human Ig-transgenic mice capable of producing human antibodies and methods of producing human antibodies therefrom upon specific immunization are described, inter alia, in U.S. Pat. Nos. 6,162,963; 6,150,584; 6,114,598; 6,075,181; 5,939,598; 5,877,397; 5,874,299; 5,814,318; 5,789,650; 5,770,429; 5,661,016; 5,633,425; 5,625,126; 5,569,825; 5,545,807; 5,545,806, and 5,591,669, the disclosures of which are incorporated herein by reference in their entireties. Such antibodies are typically monoclonal, and are typically produced using techniques developed for production of murine antibodies.

Human antibodies are particularly useful, and often preferred, when the antibodies of the present invention are to be administered to human beings as in vivo diagnostic or therapeutic agents, since recipient immune response to the administered antibody will often be substantially less than that occasioned by administration of an antibody derived from another species, such as mouse.

IgG, IgM, IgD, IgE, IgY, and IgA antibodies of the present invention are also usefully obtained from other species, including mammals such as rodents (typically mouse, but also rat, guinea pig, and hamster), lagomorphs (typically rabbits), and also larger mammals, such as sheep, goats, cows, and horses; or egg laying birds or reptiles such as chickens or alligators. In such cases, as with the transgenic human-antibody-producing non-human mammals, fortuitous immunization is not required, and the non-human mammal is typically affirmatively immunized, according to standard immunization protocols, with the polypeptide of the present invention. One form of avian antibodies may be generated using techniques described in WO 00/29444, published 25 May 2000.

As discussed above, virtually all fragments of 8 or more contiguous amino acids of a polypeptide of the present invention can be used effectively as immunogens when conjugated to a carrier, typically a protein such as bovine thyroglobulin, keyhole limpet hemocyanin, or bovine serum albumin, conveniently using a bifunctional linker such as those described elsewhere above, which discussion is incorporated by reference here.

Immunogenicity can also be conferred by fusion of the polypeptide of the present invention to other moieties. For example, polypeptides of the present invention can be produced by solid phase synthesis on a branched polylysine core matrix; these multiple antigenic peptides (MAPs) provide high purity, increased avidity, accurate chemical definition and improved safety in vaccine development. Tam et al., *Proc. Natl. Acad. Sci. USA* 85: 5409-5413 (1988); Posnett et al., *J. Biol. Chem.* 263: 1719-1725 (1988).

Protocols for immunizing non-human mammals or avian species are well-established in the art. See Harlow et al. (eds.), *Using Antibodies: A Laboratory Manual*, Cold Spring Harbor Laboratory (1998); Coligan et al. (eds.), *Current Protocols in Immunology*, John Wiley & Sons, Inc. (2001); Zola, *Monoclonal Antibodies: Preparation and Use of Monoclonal Antibodies and Engineered Antibody Derivatives (Basics: From Background to Bench)*, Springer Verlag (2000); Gross M, Speck *J. Dtsch. Tierarztl. Wochenschr.* 103: 417422 (1996). Immunization protocols often include multiple immunizations, either with or without adjuvants such as Freund's complete adjuvant and Freund's incomplete adjuvant, and may include naked DNA immunization (Moss, *Semin. Immunol.* 2: 317-327 (1990).

Antibodies from non-human mammals and avian species can be polyclonal or monoclonal, with polyclonal antibodies having certain advantages in immunohistochemical detection of the polypeptides of the present invention and monoclonal antibodies having advantages in identifying and distinguishing particular epitopes of the polypeptides of the present invention. Antibodies from avian species may have particular advantage in detection of the polypeptides of the present invention, in human serum or tissues (Vikinge et al., *Biosens. Bioelectron.* 13: 1257-1262 (1998). Following immunization, the antibodies of the present invention can be obtained using any art-accepted technique. Such techniques are well known in the art and are described in detail in references such as Coligan, supra; Zola, supra; Howard et al. (eds.), *Basic Methods in Antibody Production and Characterization*, CRC Press (2000); Harlow, supra; Davis (ed.), *Monoclonal Antibody Protocols*, Vol. 45, Humana Press (1995); Delves (ed.), *Antibody Production: Essential Techniques*, John Wiley & Son Ltd (1997); and Kenney, *Antibody Solution: An Antibody Methods Manual*, Chapman & Hall (1997).

Briefly, such techniques include, inter alia, production of monoclonal antibodies by hybridomas and expression of antibodies or fragments or derivatives thereof from host cells engineered to express immunoglobulin genes or fragments thereof. These two methods of production are not mutually exclusive: genes encoding antibodies specific for the polypeptides of the present invention can be cloned from hybridomas and thereafter expressed in other host cells. Nor need the two necessarily be performed together: e.g., genes encoding antibodies specific for the polypeptides of the present invention can be cloned directly from B cells known to be specific for the desired protein, as further described in U.S. Pat. No. 5,627,052, the disclosure of which is incorporated herein by reference in its entirety, or from antibody-displaying phage.

Recombinant expression in host cells is particularly useful when fragments or derivatives of the antibodies of the present invention are desired.

Host cells for recombinant antibody production of whole antibodies, antibody fragments, or antibody derivatives can be prokaryotic or eukaryotic.

Prokaryotic hosts are particularly useful for producing phage displayed antibodies of the present invention.

The technology of phage-displayed antibodies, in which antibody variable region fragments are fused, for example, to the gene III protein (pIII) or gene VIII protein (pVIII) for display on the surface of filamentous phage, such as M13, is by now well-established. See, e.g., Sidhu, *Curr. Opin. Biotechnol.* 11(6): 610-6 (2000); Griffiths et al., *Curr. Opin. Biotechnol.* 9(1): 102-8 (1998); Hoogenboom et al., *Immunotechnology*, 4(1): 1-20 (1998); Rader et al., *Current Opinion in Biotechnology* 8: 503-508 (1997); Aujame et al., *Human Antibodies* 8: 155-168 (1997); Hoogenboom, *Trends* in *Biotechnol*. 15: 62-70 (1997); de Kruif et al., 17: 453-455 (1996); Barbas et al., *Trends in Biotechnol*. 14: 230-234 (1996); Winter et al., *Ann. Rev. Immunol*. 433455 (1994). Techniques and protocols required to generate, propagate, screen (pan), and use the antibody fragments from such libraries have recently been compiled. See, e.g., Barbas (2001), supra; Kay, supra; and Abelson, supra.

Typically, phage-displayed antibody fragments are scFv fragments or Fab fragments; when desired, full length antibodies can be produced by cloning the variable regions from the displaying phage into a complete antibody and expressing the full length antibody in a further prokaryotic or a eukaryotic host cell. Eukaryotic cells are also useful for expression of the antibodies, antibody fragments, and antibody derivatives of the present invention. For example, antibody fragments of the present invention can be produced in *Pichia pastoris* and in *Saccharomyces cerevisiae*. See, e-g., Takahashi et al., *Biosci. Biotechnol. Biochem*. 64(10): 2138-44 (2000); Freyre et al., *J. Biotechnol*. 76(2-3): 157-63 (2000); Fischer et al, *Biotechnol. Appl. Biochem*. 30 (Pt 2): 117-20 (1999), Pennell et al., *Res. Immunol*. 149(6): 599-603 (1998); Eldin et al., *J. Immunol. Methods*. 201(1): 67-75 (1997); Frenken et al., *Res. Immunol*. 149(6): 589-99 (1998); and Shusta et al., *Nature Biotechnol*. 16(8): 773-7 (1998).

Antibodies, including antibody fragments and derivatives, of the present invention can also be produced in insect cells. See, e.g., Li et al., *Protein Expr. Purif*. 21(1): 121-8 (2001); Ailor et al. *Biotechnol. Bioeng*. 58(2-3): 196-203 (1998); Hsu et al., *Biotechnol. Prog*. 13(1): 96-104 (1997); Edelman et al., *Immunology* 91(1): 13-9 (1997); and Nesbit et al., *J. Immunol. Methods* 151(1-2): 201-8 (1992).

Antibodies and fragments and derivatives thereof of the present invention can also be produced in plant cells, particularly maize or tobacco, Giddings et al., *Nature Biotechnol*. 18(11): 1151-5 (2000); Gavilondo et al., *Biotechniques* 29(1): 128-38 (2000); Fischer et al., *J. Biol. Regul. Homeost. Agents* 14(2): 83-92 (2000); Fischer et al., *Biotechnol. Appl. Biochem*. 30 (Pt 2): 113-6 (1999); Fischer et al., *Biol. Chem*. 380(7-8): 825-39 (1999); Russell, *Curr. Top. Microbiol. Immunol*. 240: 119-38 (1999); and Ma et al., *Plant Physiol*. 109(2): 341-6 (1995).

Antibodies, including antibody fragments and derivatives, of the present invention can also be produced in transgenic, non-human, mammalian milk. See, e.g. Pollock et al., *J. Immunol Methods*. 231: 147-57 (1999); Young et al., *Res. Immunol*. 149: 609-10 (1998); and Limonta et al., *Immunotechnology* 1: 107-13 (1995).

Mammalian cells useful for recombinant expression of antibodies, antibody fragments, and antibody derivatives of the present invention include CHO cells, COS cells, 293 cells, and myeloma cells. Verma et al., *J. Immunol. Methods* 216 (1-2):165-81 (1998) review and compare bacterial, yeast, insect and mammalian expression systems for expression of antibodies. Antibodies of the present invention can also be prepared by cell free translation, as further described in Merk et al., *J. Biochem*. (Tokyo) 125(2): 328-33 (1999) and Ryabova et al., *Nature Biotechnol*. 15(1): 79-84 (1997), and in the milk of transgenic animals, as further described in Pollock et al., *J. Immunol Methods* 231(1-2): 147-57 (1999).

The invention further provides antibody fragments that bind specifically to one or more of the polypeptides of the present invention, to one or more of the polypeptides encoded by the isolated nucleic acid molecules of the present invention, or the binding of which can be competitively inhibited by one or more of the polypeptides of the present invention or one or more of the polypeptides encoded by the isolated nucleic acid molecules of the present invention. Among such useful fragments are Fab, Fab', Fv, F(ab)'$_2$, and single chain Fv (scFv) fragments. Other useful fragments are described in Hudson, *Curr. Opin. Biotechnol*. 9(4): 395402 (1998).

The present invention also relates to antibody derivatives that bind specifically to one or more of the polypeptides of the present invention, to one or more of the polypeptides encoded by the isolated nucleic acid molecules of the present invention, or the binding of which can be competitively inhibited by one or more of the polypeptides of the present invention or one or more of the polypeptides encoded by the isolated nucleic acid molecules of the present invention.

Among such useful derivatives are chimeric, primatized, and humanized antibodies; such derivatives are less immunogenic in human beings, and thus are more suitable for in vivo administration, than are unmodified antibodies from non-human mammalian species. Another useful method is PEGylation to increase the serum half life of the antibodies.

Chimeric antibodies typically include heavy and/or light chain variable regions (including both CDR and framework residues) of immunoglobulins of one species, typically mouse, fused to constant regions of another species, typically human. See, e.g., Morrison et al., *Proc. Natl. Acad. Sci USA*. 81(21): 6851-5 (1984); Sharon et al., *Nature* 309(5966): 364-7 (1984); Takeda et al. *Nature* 314(6010): 452-4 (1985); and U.S. Pat. No. 5,807,715 the disclosure of which is incorporated herein by reference in its entirety. Primatized and humanized antibodies typically include heavy and/or light chain CDRs from a murine antibody grafted into a non-human primate or human antibody V region framework, usually further comprising a human constant region, Riechmann et al., *Nature* 332(6162): 323-7 (1988); Co et al., *Nature* 351(6326): 501-2 (1991); and U.S. Pat. Nos. 6,054,297; 5,821,337; 5,770,196; 5,766,886; 5,821,123; 5,869,619; 6,180,377; 6,013,256; 5,693,761; and 6,180,370, the disclosures of which are incorporated herein by reference in their entireties. Other useful antibody derivatives of the invention include heteromeric antibody complexes and antibody fusions, such as diabodies (bispecific antibodies), single-chain diabodies, and intrabodies.

It is contemplated that the nucleic acids encoding the antibodies of the present invention can be operably joined to other nucleic acids forming a recombinant vector for cloning or for expression of the antibodies of the invention. Accordingly, the present invention includes any recombinant vector containing the coding sequences, or part thereof, whether for eukaryotic transduction, transfection or gene therapy. Such vectors may be prepared using conventional molecular biology techniques, known to those with skill in the art, and would comprise DNA encoding sequences for the immunoglobulin V-regions including framework and CDRs or parts thereof, and a suitable promoter either with or without a signal sequence for intracellular transport. Such vectors may be transduced or transfected into eukaryotic cells or used for gene therapy (Marasco et al., *Proc. Natl. Acad. Sci*. (*USA*) 90: 7889-7893 (1993); Duan et al., *Proc. Natl. Acad. Sci*. (*USA*) 91: 5075-5079 (1994), by conventional techniques, known to those with skill in the art.

The antibodies of the present invention, including fragments and derivatives thereof, can usefully be labeled. It is, therefore, another aspect of the present invention to provide labeled antibodies that bind specifically to one or more of the polypeptides of the present invention, to one or more of the polypeptides encoded by the isolated nucleic acid molecules of the present invention, or the binding of which can be competitively inhibited by one or more of the polypeptides of the present invention or one or more of the polypeptides encoded by the isolated nucleic acid molecules of the present invention. The choice of label depends, in part, upon the desired use.

For example, when the antibodies of the present invention are used for immunohistochemical staining of tissue samples, the label can usefully be an enzyme that catalyzes production and local deposition of a detectable product. Enzymes typically conjugated to antibodies to permit their immunohistochemical visualization are well known, and include alkaline phosphatase, β-galactosidase, glucose oxidase, horseradish peroxidase (HRP), and urease. Typical substrates for production and deposition of visually detectable products include o-nitrophenyl-beta-D-galactopyranoside (ONPG); o-phenylenediamine dihydrochloride (OPD); p-nitrophenyl phosphate (PNPP); p-nitrophenyl-beta-D-galactopryanoside (PNPG); 3',3'-diaminobenzidine (DAB); 3-amino-9-ethyl-carbazole (AEC); 4-chloro-1-naphthol (CN); 5-bromo-4-chloro-3-indolyl-phosphate (BCIP); ABTS®; BluoGal; iodonitrotetrazolium (INT); nitroblue tetrazolium chloride (NBT); phenazine methosulfate (PMS); phenolphthalein monophosphate (PMP); tetramethyl benzidine (TMB); tetranitroblue tetrazolium (TNBT); X-Gal; X-Gluc; and X-Glucoside.

Other substrates can be used to produce products for local deposition that are luminescent. For example, in the presence of hydrogen peroxide ($H_2O_2$), horseradish peroxidase (HRP) can catalyze the oxidation of cyclic diacylhydrazides, such as luminol. Immediately following the oxidation, the luminol is in an excited state (intermediate reaction product), which decays to the ground state by emitting light Strong enhancement of the light emission is produced by enhancers, such as phenolic compounds. Advantages include high sensitivity, high resolution, and rapid detection without radioactivity and requiring only small amounts of antibody. See, e.g., Thorpe et al., *Methods Enzymol.* 133: 331-53 (1986); Kricka et al, *J. Immunoassay* 17(1): 67-83 (1996); and Lundqvist et al., *J. Biolumin. Chemilumin.* 10(6): 353-9 (1995). Kits for such enhanced chemiluminescent detection (ECL) are available commercially. The antibodies can also be labeled using colloidal gold.

As another example, when the antibodies of the present invention are used, e.g., for flow cytometric detection, for scanning laser cytometric detection, or for fluorescent immunoassay, they can usefully be labeled with fluorophores. There are a wide variety of fluorophore labels that can usefully be attached to the antibodies of the present invention. For flow cytometric applications, both for extracellular detection and for intracellular detection, common useful fluorophores can be fluorescein isothiocyanate (FITC), allophycocyanin (APC), R-phycoerythrin (PE), peridinin chlorophyll protein (PerCP), Texas Red, Cy3, Cy5, fluorescence resonance energy tandem fluorophores such as PerCP-Cy5.5, PE-Cy5, PE-Cy5.5, PE-Cy7, PE-Texas Red, and APC-Cy7.

Other fluorophores include, inter alia, Alexa Fluor® 350, Alexa Fluor® 488, Alexa Fluor® 532, Alexa Fluor® 546, Alexa Fluor® 568, Alexa Fluor® 594, Alexa Fluor® 647 (monoclonal antibody labeling kits available from Molecular Probes, Inc., Eugene, Oreg., USA), BODIPY dyes, such as BODIPY 493/503, BODIPY FL, BODIPY R6G, BODIPY 530/550, BODIPY TMR, BODIPY 558/568, BODIPY 558/568, BODIPY 564/570, BODIPY 576/589, BODIPY 581/591, BODIPY TR, BODIPY 630/650, BODIPY 650/665, Cascade Blue, Cascade Yellow, Dansyl, lissamine rhodamine B, Marina Blue, Oregon Green 488, Oregon Green 514, Pacific Blue, rhodamine 6G, rhodamine green, rhodamine red, tetramethylrhodamine, Texas Red (available from Molecular Probes, Inc., Eugene, Oreg., USA), and Cy2, Cy3, Cy3.5, Cy5, Cy5.5, Cy7, all of which are also useful for fluorescently labeling the antibodies of the present invention. For secondary detection using labeled avidin, streptavidin, captavidin or neutravidin, the antibodies of the present invention can usefully be labeled with biotin.

When the antibodies of the present invention are used, e.g., for western blotting applications, they can usefully be labeled with radioisotopes, such as $^{33}P$, $^{32}P$, $^{35}S$, $^{3}H$, and $^{125}I$. As another example, when the antibodies of the present invention are used for radioimmunotherapy, the label can usefully be $^{228}Th$, $^{227}Ac$, $^{225}Ac$, $^{223}Ra$, $^{213}Bi$, $^{212}Pb$, $^{212}Bi$, $^{211}At$, $^{203}Pb$, $^{194}Os$, $^{188}Re$, $^{186}Re$, $^{153}Sm$, $^{149}Tb$, $^{131}I$, $^{125}I$, $^{111}In$, $^{105}Rh$, $^{99m}Tc$, $^{97}Ru$, $^{90}Y$, $^{90}Sr$, $^{88}Y$, $^{72}Se$, $^{67}Cu$, or $^{47}Sc$.

As another example, when the antibodies of the present invention are to be used for in vivo diagnostic use, they can be rendered detectable by conjugation to MRI contrast agents, such as gadolinium diethylenetriaminepentaacetic acid (DTPA), Lauffer et at., *Radiology* 207(2): 529-38 (1998), or by radioisotopic labeling.

As would be understood, use of the labels described above is not restricted to the application as for which they were mentioned.

The antibodies of the present invention, including fragments and derivatives thereof, can also be conjugated to toxins, in order to target the toxin's ablative action to cells that display and/or express the polypeptides of the present invention. Commonly, the antibody in such immunotoxins is conjugated to *Pseudomonas* exotoxin A, diphtheria toxin, shiga toxin A, anthrax toxin lethal factor, or ricin. See Hall (ed.), *Immunotoxin Methods and Protocols* (Methods in Molecular Biology, vol. 166), Humana Press (2000); and Frankel et al. (eds.), *Clinical Applications of Immunotoxins*, Springer-Verlag (1998).

The antibodies of the present invention can usefully be attached to a substrate, and it is, therefore, another aspect of the invention to provide antibodies that bind specifically to one or more of the polypeptides of the present invention, to one or more of the polypeptides encoded by the isolated nucleic acid molecules of the present invention, or the binding of which can be competitively inhibited by one or more of the polypeptides of the present invention or one or more of the polypeptides encoded by the isolated nucleic acid molecules of the present invention, attached to a substrate. Substrates can be porous or nonporous, planar or nonplanar. For example, the antibodies of the present invention can usefullly be conjugated to filtration media, such as NHS-activated Sepharose or CNBr-activated Sepharose for purposes of immunoaffinity chromatography. For example, the antibodies of the present invention can usefully be attached to paramagnetic microspheres, typically by biotin-streptavidin interaction, which microsphere can then be used for isolation of cells that express or display the polypeptides of the present invention. As another example, the antibodies of the present invention can usefully be attached to the surface of a microtiter plate for ELISA.

As noted above, the antibodies of the present invention can be produced in prokaryotic and eukaryotic cells. It is, therefore, another aspect of the present invention to provide cells that express the antibodies of the present invention, including hybridoma cells, B cells, plasma cells, and host cells recombinantly modified to express the antibodies of the present invention.

In yet a further aspect, the present invention provides aptamers evolved to bind specifically to one or more of the OSPs of the present invention or to polypeptides encoded by the OSNAs of the invention.

In sum, one of skill in the art, provided with the teachings of this invention, has available a variety of methods which may be used to alter the biological properties of the antibodies of this invention including methods which would increase or decrease the stability or half-life, immunogenicity, toxicity, affinity or yield of a given antibody molecule, or to alter it in any other way that may render it more suitable for a particular application.

Transgenic Animals and Cells

In another aspect, the invention provides transgenic cells and non-human organisms comprising nucleic acid molecules of the invention. In a preferred embodiment, the transgenic cells and non-human organisms comprise a nucleic acid molecule encoding a OSP. In a preferred embodiment, the OSP comprises an amino acid sequence selected from SEQ ID NO: 249-396, or a fragment, mutein, homologous protein or allelic variant thereof. In another preferred embodiment, the transgenic cells and non-human organism comprise a OSNA of the invention, preferably a OSNA comprising a nucleotide sequence selected from the group consisting of SEQ ID NO: 1-248, or a part, substantially similar nucleic acid molecule, allelic variant or hybridizing nucleic acid molecule thereof.

In another embodiment, the transgenic cells and non-human organisms have a targeted disruption or replacement of the endogenous orthologue of the human OSG. The transgenic cells can be embryonic stem cells or somatic cells. The transgenic non-human organisms can be chimeric, nonchimeric heterozygotes, and nonchimeric homozygotes. Methods of producing transgenic animals are well known in the art See, e.g., Hogan et al., *Manipulating the Mouse Embryo: A Laboratory Manual,* 2d ed., Cold Spring Harbor Press (1999); Jackson et al., *Mouse Genetics and Transgenics: A Practical Approach* Oxford University Press (2000); and Pinkert, *Transgenic Animal Technology: A Laboratory Handbook,* Academic Press (1999).

Any technique known in the art may be used to introduce a nucleic acid molecule of the invention into an animal to produce the founder lines of transgenic animals. Such techniques include, but are not limited to, pronuclear microinjection. (see, e.g. Paterson et al., *Appl. Microbiol. Biotechnol.* 40: 691-698 (1994); Carver et al., *Biotechnology* 11: 1263-1270 (1993); Wright et al., *Biotechnology* 9: 830-834 (1991); and U.S. Pat. No. 4,873,191, herein incorporated by reference in its entirety); retrovirus-mediated gene transfer into germ lines, blastocysts or embryos (see, e.g., Van der Putten et al., *Proc. Natl. Acad. Sci., USA* 82: 6148-6152 (1985)); gene targeting in embryonic stem cells (see, e.g., Thompson et al, *Cell* 56: 313-321 (1989)); electroporation of cells or embryos (see, e.g., Lo, 1983, *Mol. Cell. Biol.* 3: 1803-1814 (1983)); introduction using a gene gun (see, e.g., Ulmer et al., *Science* 259: 174549 (1993); introducing nucleic acid constructs into embryonic pleuripotent stem cells and transferring the stem cells back into the blastocyst; and sperm-mediated gene transfer (see, e.g., Lavitrano et al., *Cell* 57: 717-723 (1989)).

Other techniques include, for example, nuclear transfer into enucleated oocytes of nuclei from cultured embryonic, fetal, or adult cells induced to quiescence (see, e.g., Campell et al., *Nature* 380: 64-66 (1996); Wilmut et al., *Nature* 385: 810-813 (1997)). The present invention provides for transgenic animals that carry the transgene (i.e., a nucleic acid molecule of the invention) in all their cells, as well as animals which carry the transgene in some, but not all their cells, i.e. e., mosaic animals or chimeric animals.

The transgene may be integrated as a single transgene or as multiple copies, such as in concatamers, e.g., head-to-head tandems or head-to-tail tandems. The transgene may also be selectively introduced into and activated in a particular cell type by following, e.g., the teaching of Lasko et al. et al., *Proc. Natl. Acad. Sci. USA* 89: 6232-6236 (1992). The regulatory sequences required for such a cell-type specific activation will depend upon the particular cell type of interest, and will be apparent to those of skill in the art.

Once transgenic animals have been generated, the expression of the recombinant gene may be assayed utilizing standard techniques. Initial screening may be accomplished by Southern blot analysis or PCR techniques to analyze animal tissues to verify that integration of the transgene has taken place. The level of mRNA expression of the transgene in the tissues of the transgenic animals may also be assessed using techniques which include, but are not limited to, Northern blot analysis of tissue samples obtained from the animal, in situ hybridization analysis, and reverse transcriptase-PCR (RT-PCR). Samples of transgenic gene-expressing tissue may also be evaluated immunocytochemically or immunohistochemically using antibodies specific for the transgene product.

Once the founder animals are produced, they may be bred, inbred, outbred, or crossbred to produce colonies of the particular animal. Examples of such breeding strategies include, but are not limited to: outbreeding of founder animals with more than one integration site in order to establish separate lines; inbreeding of separate lines in order to produce compound transgenics that express the transgene at higher levels because of the effects of additive expression of each transgene; crossing of heterozygous transgenic animals to produce animals homozygous for a given integration site in order to both augment expression and eliminate the need for screening of animals by DNA analysis; crossing of separate homozygous lines to produce compound heterozygous or homozygous lines; and breeding to place the transgene on a distinct background that is appropriate for an experimental model of interest.

Transgenic animals of the invention have uses which include, but are not limited to, animal model systems useful in elaborating the biological function of polypeptides of the present invention, studying conditions and/or disorders associated with aberrant expression, and in screening for compounds effective in ameliorating such conditions and/or disorders.

Methods for creating a transgenic animal with a disruption of a targeted gene are also well known in the art. In general, a vector is designed to comprise some nucleotide sequences homologous to the endogenous targeted gene. The vector is introduced into a cell so that it may integrate, via homologous recombination with chromosomal sequences, into the endogenous gene, thereby disrupting the function of the endogenous gene. The transgene may also be selectively introduced into a particular cell type, thus inactivating the endogenous gene in only that cell type. See, e.g., Gu et al., *Science* 265: 103-106 (1994). The regulatory sequences required for such a cell-type specific inactivation will depend upon the particular cell type of interest, and will be apparent to those of skill in the art See, e.g., Smithies et al., *Nature* 317: 230-234 (1985); Thomas et al., *Cell* 51: 503-512 (1987); Thompson et al., *Cell* 5: 313-321 (1989).

In one embodiment, a mutant, non-functional nucleic acid molecule of the invention (or a completely unrelated DNA sequence) flanked by DNA homologous to the endogenous nucleic acid sequence (either the coding regions or regulatory regions of the gene) can be used, with or without a selectable marker and/or a negative selectable marker, to transfect cells that express polypeptides of the invention in vivo. In another embodiment, techniques known in the art are used to generate knockouts in cells that contain, but do not express the gene of interest. Insertion of the DNA construct, via targeted homologous recombination, results in inactivation of the targeted gene. Such approaches are particularly suited in research and agricultural fields where modifications to embryonic stem cells can be used to generate animal offspring with an inactive targeted gene. See, e.g., Thomas, supra and Thompson, supra. However this approach can be routinely adapted for use in humans provided the recombinant DNA constructs are directly administered or targeted to the required site in vivo using appropriate viral vectors that will be apparent to those of skill in the art.

In further embodiments of the invention, cells that are genetically engineered to express the polypeptides of the invention, or alternatively, that are genetically engineered not to express the polypeptides of the invention (e.g., knockouts) are administered to a patient in vivo. Such cells may be obtained from an animal or patient or an MHC compatible donor and can include, but are not limited to fibroblasts, bone marrow cells, blood cells (e.g., lymphocytes), adipocytes, muscle cells, endothelial cells etc. The cells are genetically engineered in vitro using recombinant DNA techniques to introduce the coding sequence of polypeptides of the invention into the cells, or alternatively, to disrupt the coding sequence and/or endogenous regulatory sequence associated with the polypeptides of the invention, e.g., by transduction (using viral vectors, and preferably vectors that integrate the transgene into the cell genome) or transfection procedures, including, but not limited to, the use of plasmids, cosmids, YACs, naked DNA, electroporation, liposomes, etc.

The coding sequence of the polypeptides of the invention can be placed under the control of a strong constitutive or inducible promoter or promoter/enhancer to achieve expression, and preferably secretion, of the polypeptides of the invention. The engineered cells which express and preferably secrete the polypeptides of the invention can be introduced into the patient systemically, e.g., in the circulation, or intraperitoneally.

Alternatively, the cells can be incorporated into a matrix and implanted in the body, e.g., genetically engineered fibroblasts can be implanted as part of a skin graft; genetically engineered endothelial cells can be implanted as part of a lymphatic or vascular graft See, e.g., U.S. Pat. Nos. 5,399,349 and 5,460,959, each of which is incorporated by reference herein in its entirety.

When the cells to be administered are non-autologous or non-MHC compatible cells, they can be administered using well known techniques which prevent the development of a host immune response against the introduced cells. For example, the cells may be introduced in an encapsulated form which, while allowing for an exchange of components with the immediate extracellular environment, does not allow the introduced cells to be recognized by the host immune system.

Transgenic and "knock-out" animals of the invention have uses which include, but are not limited to, animal model systems useful in elaborating the biological function of polypeptides of the present invention, studying conditions and/or disorders associated with aberrant expression, and in screening for compounds effective in ameliorating such conditions and/or disorders.

Computer Readable Means

A further aspect of the invention is a computer readable means for storing the nucleic acid and amino acid sequences of the instant invention. In a preferred embodiment, the invention provides a computer readable means for storing SEQ ID NO: 249-396 and SEQ ID NO: 1-248 as described herein, as the complete set of sequences or in any combination. The records of the computer readable means can be accessed for reading and display and for interface with a computer system for the application of programs allowing for the location of data upon a query for data meeting certain criteria, the comparison of sequences, the alignment or ordering of sequences meeting a set of criteria, and the like.

The nucleic acid and amino acid sequences of the invention are particularly useful as components in databases useful for search analyses as well as in sequence analysis algorithms. As used herein, the terms "nucleic acid sequences of the invention" and "amino acid sequences of the invention" mean any detectable chemical or physical characteristic of a polynucleotide or polypeptide of the invention that is or may be reduced to or stored in a computer readable form. These include, without limitation, chromatographic scan data or peak data, photographic data or scan data therefrom, and mass spectrographic data.

This invention provides computer readable media having stored thereon sequences of the invention. A computer readable medium may comprise one or more of the following: a nucleic acid sequence comprising a sequence of a nucleic acid sequence of the invention; an amino acid sequence comprising an amino acid sequence of the invention; a set of nucleic acid sequences wherein at least one of said sequences comprises the sequence of a nucleic acid sequence of the invention; a set of amino acid sequences wherein at least one of said sequences comprises the sequence of an amino acid sequence of the invention; a data set representing a nucleic acid sequence comprising the sequence of one or more nucleic acid sequences of the invention; a data set representing a nucleic acid sequence encoding an amino acid sequence comprising the sequence of an amino acid sequence of the invention; a set of nucleic acid sequences wherein at least one of said sequences comprises the sequence of a nucleic acid sequence of the invention; a set of amino acid sequences wherein at least one of said sequences comprises the sequence of an amino acid sequence of the invention; a data set representing a nucleic acid sequence comprising the sequence of a nucleic acid sequence of the invention; a data set representing a nucleic acid sequence encoding an amino acid sequence comprising the sequence of an amino acid sequence of the invention. The computer readable medium can be any composition of matter used to store information or data, including, for example, commercially available floppy disks, tapes, hard drives, compact disks, and video disks.

Also provided by the invention are methods for the analysis of character sequences, particularly genetic sequences. Preferred methods of sequence analysis include, for example, methods of sequence homology analysis, such as identity and similarity analysis, RNA structure analysis, sequence assembly, cladistic analysis, sequence motif analysis, open reading frame determination, nucleic acid base calling, and sequencing chromatogram peak analysis.

A computer-based method is provided for performing nucleic acid sequence identity or similarity identification. This method comprises the steps of providing a nucleic acid sequence comprising the sequence of a nucleic acid of the invention in a computer readable medium; and comparing said nucleic acid sequence to at least one nucleic acid or amino acid sequence to identify sequence identity or similarity.

A computer-based method is also provided for performing amino acid homology identification, said method comprising the steps of: providing an amino acid sequence comprising the sequence of an amino acid of the invention in a computer readable medium; and comparing said amino acid sequence to at least one nucleic acid or an amino acid sequence to identify homology.

A computer-based method is still further provided for assembly of overlapping nucleic acid sequences into a single nucleic acid sequence, said method comprising the steps of: providing a first nucleic acid sequence comprising the sequence of a nucleic acid of the invention in a computer readable medium; and screening for at least one overlapping region between said first nucleic acid sequence and a second nucleic acid sequence. In addition, the invention includes a method of using patterns of expression associated with either the nucleic acids or proteins in a computer-based method to diagnose disease.

Diagnostic Methods for Ovarian Cancer

The present invention also relates to quantitative and qualitative diagnostic assays and methods for detecting, diagnosing, monitoring, staging and predicting cancers by comparing expression of a OSNA or a OSP in a human patient that has or may have ovarian cancer, or who is at risk of developing ovarian cancer, with the expression of a OSNA or a OSP in a normal human control. For purposes of the present invention, "expression of a OSNA" or "OSNA expression" means the quantity of OSNA mRNA that can be measured by any method known in the art or the level of transcription that can be measured by any method known in the art in a cell, tissue, organ or whole patient. Similarly, the term "expression of a OSP" or "OSP expression" means the amount of OSP that can be measured by any method known in the art or the level of translation of a OSNA that can be measured by any method known in the art.

The present invention provides methods for diagnosing ovarian cancer in a patient, by analyzing for changes in levels of OSNA or OSP in cells, tissues, organs or bodily fluids compared with levels of OSNA or OSP in cells, tissues, organs or bodily fluids of preferably the same type from a normal human control, wherein an increase, or decrease in certain cases, in levels of a OSNA or OSP in the patient versus the normal human control is associated with the presence of ovarian cancer or with a predilection to the disease. In another preferred embodiment, the present invention provides methods for diagnosing ovarian cancer in a patient by analyzing changes in the structure of the mRNA of a OSG compared to the mRNA from a normal control. These changes include, without limitation, aberrant splicing, alterations in polyadenylation and/or alterations in 5' nucleotide capping. In yet another preferred embodiment, the present invention provides methods for diagnosing ovarian cancer in a patient by analyzing changes in a OSP compared to a OSP from a normal patient. These changes include, e.g., alterations, including post translational modifications such as glycosylation and/or phosphorylation of the OSP or changes in the subcellular OSP localization.

For purposes of the present invention, diagnosing means that OSNA or OSP levels are used to determine the presence or absence of disease in a patient. As will be understood by those of skill in the art, measurement of other diagnostic parameters may be required for definitive diagnosis or determination of the appropriate treatment for the disease. The determination may be made by a clinician, a doctor, a testing laboratory, or a patient using an over the counter test. The patient may have symptoms of disease or may be asymptomatic. In addition, the OSNA or OSP levels of the present invention may be used as screening marker to determine whether further tests or biopsies are warranted. In addition, the OSNA or OSP levels may be used to determine the vulnerability or susceptibility to disease.

In a preferred embodiment, the expression of a OSNA is measured by determining the amount of a mRNA that encodes an amino acid sequence selected from SEQ ID NO: 249-396, a homolog, an allelic variant, or a fragment thereof. In a more preferred embodiment, the OSNA expression that is measured is the level of expression of a OSNA mRNA selected from SEQ ID NO: 1-248, or a hybridizing nucleic acid, homologous nucleic acid or allelic variant thereof, or a part of any of these nucleic acid molecules. OSNA expression may be measured by any method known in the art, such as those described supra, including measuring mRNA expression by Northern blot, quantitative or qualitative reverse transcriptase PCR (RT-PCR), microarray, dot or slot blots or in situ hybridization. See, e.g., Ausubel (1992), supra; Ausubel (1999), supra; Sambrook (1989), supra; and Sambrook (2001), supra. OSNA transcription may be measured by any method known in the art including using a reporter gene hooked up to the promoter of a OSG of interest or doing nuclear run-off assays. Alterations in mRNA structure, e.g., aberrant splicing variants, may be determined by any method known in the art, including, RT-PCR followed by sequencing or restriction analysis. As necessary, OSNA expression may be compared to a known control, such as normal ovarian nucleic acid, to detect a change in expression.

In another preferred embodiment, the expression of a OSP is measured by determining the level of a OSP having an amino acid sequence selected from the group consisting of SEQ ID NO: 249-396, a homolog, an allelic variant, or a fragment thereof. Such levels are preferably determined in at least one of cells, tissues, organs and/or bodily fluids, including determination of normal and abnormal levels. Thus, for instance, a diagnostic assay in accordance with the invention for diagnosing over- or underexpression of a OSNA or OSP compared to normal control bodily fluids, cells, or tissue samples may be used to diagnose the presence of ovarian cancer. The expression level of a OSP may be determined by any method known in the art, such as those described supra. In a preferred embodiment, the OSP expression level may be determined by radioimmunoassays, competitive-binding assays, ELISA, Western blot, FACS, immunohistochemistry, immunoprecipitation, proteomic approaches: two-dimensional gel electrophoresis (2D electrophoresis) and non-gel-based approaches such as mass spectrometry or protein interaction profiling. See, e.g, Harlow (1999), supra; Ausubel (1992), supra; and Ausubel (1999), supra. Alterations in the OSP structure may be determined by any method known in the art, including, e.g., using antibodies that specifically recognize phosphoserine, phosphothreonine or phosphotyrosine residues, two-dimensional polyacrylamide gel electrophoresis (2D PAGE) and/or chemical analysis of amino acid residues of the protein. Id.

In a preferred embodiment, a radioimmunoassay (RIA) or an ELISA is used. An antibody specific to a OSP is prepared if one is not already available. In a preferred embodiment, the antibody is a monoclonal antibody. The anti-OSP antibody is bound to a solid support and any free protein binding sites on the solid support are blocked with a protein such as bovine serum albumin. A sample of interest is incubated with the antibody on the solid support under conditions in which the OSP will bind to the anti-OSP antibody. The sample is removed, the solid support is washed to remove unbound material, and an anti-OSP antibody that is linked to a detectable reagent (a radioactive substance for RIA and an enzyme for ELISA) is added to the solid support and incubated under conditions in which binding of the OSP to the labeled antibody will occur. After binding, the unbound labeled antibody is removed by washing. For an ELISA, one or more substrates are added to produce a colored reaction product that is based upon the amount of an OSP in the sample. For an RIA, the solid support is counted for radioactive decay signals by any method known in the art. Quantitative results for both RIA and ELISA typically are obtained by reference to a standard curve.

Other methods to measure OSP levels are known in the art. For instance, a competition assay may be employed wherein an anti-OSP antibody is attached to a solid support and an allocated amount of a labeled OSP and a sample of interest are incubated with the solid support. The amount of labeled OSP attached to the solid support can be correlated to the quantity of a OSP in the sample.

Of the proteomic approaches, 2D PAGE is a well known technique. Isolation of individual proteins from a sample such as serum is accomplished using sequential separation of proteins by isoelectric point and molecular weight Typically, polypeptides are first separated by isoelectric point (the first dimension) and then separated by size using an electric current (the second dimension). In general, the second dimension is perpendicular to the first dimension. Because no two proteins with different sequences are identical on the basis of both size and charge, the result of 2D PAGE is a roughly square gel in which each protein occupies a unique spot. Analysis of the spots with chemical or antibody probes, or subsequent protein microsequencing can reveal the relative abundance of a given protein and the identity of the proteins in the sample.

Expression levels of a OSNA can be determined by any method known in the art, including PCR and other nucleic acid methods, such as ligase chain reaction (LCR) and nucleic acid sequence based amplification (NASBA), can be used to detect malignant cells for diagnosis and monitoring of various malignancies. For example, reverse-transcriptase PCR (RT-PCR) is a powerful technique which can be used to detect the presence of a specific mRNA population in a complex mixture of thousands of other mRNA species. In RT-PCR, an mRNA species is first reverse transcribed to complementary DNA (cDNA) with use of the enzyme reverse transcriptase; the cDNA is then amplified as in a standard PCR reaction.

Hybridization to specific DNA molecules (e.g., oligonucleotides) arrayed on a solid support can be used to both detect the expression of and quantitate the level of expression of one or more OSNAs of interest. In this approach, all or a portion of one or more OSNAs is fixed to a substrate. A sample of interest, which may comprise RNA, e.g., total RNA or polyA-selected mRNA, or a complementary DNA (cDNA) copy of the RNA is incubated with the solid support under conditions in which hybridization will occur between the DNA on the solid support and the nucleic acid molecules in the sample of interest. Hybridization between the substrate-bound DNA and the nucleic acid molecules in the sample can be detected and quantitated by several means, including, without limitation, radioactive labeling or fluorescent labeling of the nucleic acid molecule or a secondary molecule designed to detect the hybrid.

The above tests can be carried out on samples derived from a variety of cells, bodily fluids and/or tissue extracts such as homogenates or solubilized tissue obtained from a patient. Tissue extracts are obtained routinely from tissue biopsy and autopsy material. Bodily fluids useful in the present invention include blood, urine, saliva or any other bodily secretion or derivative thereof. As used herein "blood" includes whole blood, plasma, serum, circulating epithelial cells, constituents, or any derivative of blood.

In addition to detection in bodily fluids, the proteins and nucleic acids of the invention are suitable to detection by cell capture technology. Whole cells may be captured by a variety methods for example magnetic separation, U.S. Pat. Nos. 5,200,084; 5,186,827; 5,108,933; 4,925,788, the disclosures of which are incorporated herein by reference in their entireties. Epithelial cells may be captured using such products as Dynabeads® or CELLection™ (Dynal Biotech, Oslo, Norway). Alternatively, fractions of blood may be captured, e.g., the buffy coat fraction (50 mm cells isolated from 5 ml of blood) containing epithelial cells. In addition, cancer cells may be captured using the techniques described in WO 00/47998, the disclosure of which is incorporated herein by reference in its entirety. Once the cells are captured or concentrated, the proteins or nucleic acids are detected by the means described in the subject application. Alternatively, nucleic acids may be captured directly from blood samples, see U.S. Pat. Nos. 6,156,504, 5,501,963; or WO 01/42504, the disclosures of which are incorporated herein by reference in their entireties.

In a preferred embodiment, the specimen tested for expression of OSNA or OSP includes without limitation ovarian tissue, ovarian cells grown in cell culture, blood, serum, lymph node tissue, and lymphatic fluid. In another preferred embodiment, especially when metastasis of a primary ovarian cancer is known or suspected, specimens include, without limitation, tissues from brain, bone, bone marrow, liver, lungs, colon, and adrenal glands. In general, the tissues may be sampled by biopsy, including, without limitation, needle biopsy, e.g., transthoracic needle aspiration, cervical mediatinoscopy, endoscopic lymph node biopsy, video-assisted thoracoscopy, exploratory thoracotomy, bone marrow biopsy and bone marrow aspiration.

All the methods of the present invention may optionally include determining the expression levels of one or more other cancer markers in addition to determining the expression level of a OSNA or OSP. In many cases, the use of another cancer marker will decrease the likelihood of false positives or false negatives. In one embodiment, the one or more other cancer markers include other OSNA or OSPs as disclosed herein. Other cancer markers useful in the present invention will depend on the cancer being tested and are known to those of skill in the art; In a preferred embodiment, at least one other cancer marker in addition to a particular OSNA or OSP is measured. In a more preferred embodiment, at least two other additional cancer markers are used. In an even more preferred embodiment, at least three, more preferably at least five, even more preferably at least ten additional cancer markers are used.

Diagnosing

In one aspect, the invention provides a method for determining the expression levels and/or structural alterations of one or more OSNA and/or OSP in a sample from a patient suspected of having ovarian cancer. In general, the method comprises the steps of obtaining the sample from the patient, determining the expression level or structural alterations of a OSNA and/or OSP and then ascertaining whether the patient has ovarian cancer from the expression level of the OSNA or OSP. In general, if high expression relative to a control of a OSNA or OSP is indicative of ovarian cancer, a diagnostic assay is considered positive if the level of expression of the OSNA or OSP is at least one and a half times higher, and more preferably are at least two times higher, still more preferably five times higher, even more preferably at least ten times higher, than in preferably the same cells, tissues or bodily fluid of a normal human control. In contrast, if low expression relative to a control of a OSNA or OSP is indicative of ovarian cancer, a diagnostic assay is considered positive if the level of expression of the OSNA or OSP is at least one and a half times lower, and more preferably are at least two times lower, still more preferably five times lower, even more preferably at least ten times lower than in preferably the same cells, tissues or bodily fluid of a normal human control. The normal human control may be from a different patient or from uninvolved tissue of the same patient.

The present invention also provides a method of determining whether ovarian cancer has metastasized in a patient. One may identify whether the ovarian cancer has metastasized by measuring the expression levels and/or structural alterations of one or more OSNAs and/or OSPs in a variety of tissues. The presence of a OSNA or OSP in a certain tissue at levels higher than that of corresponding noncancerous tissue (e.g., the same tissue from another individual) is indicative of metastasis if high level expression of a OSNA or OSP is associated with ovarian cancer. Similarly, the presence of a OSNA or OSP in a tissue at levels lower than that of corresponding noncancerous tissue is indicative of metastasis if low level expression of a OSNA or OSP is associated with ovarian cancer. Further, the presence of a structurally altered OSNA or OSP that is associated with ovarian cancer is also indicative of metastasis.

In general, if high expression relative to a control of a OSNA or OSP is indicative of metastasis, an assay for metastasis is considered: positive if the level of expression of the OSNA or OSP is at least one and a half times higher, and more preferably are at least two times higher, still more preferably five times higher, even more preferably at least ten times higher, than in preferably the same cells, tissues or bodily fluid of a normal human control. In contrast, if low expression relative to a control of a OSNA or OSP is indicative of metastasis, an assay for metastasis is considered positive if the level of expression of the OSNA or OSP is at least one and a half times lower, and more preferably are at least two times lower, still more preferably five times lower, even more preferably at least ten times lower than in preferably the same cells, tissues or bodily fluid of a normal human control.

Staging

The invention also provides a method of staging ovarian cancer in a human patient. The method comprises identifying a human patient having ovarian cancer and analyzing cells, tissues or bodily fluids from such human patient for expression levels and/or structural alterations of one or more OSNAs or OSPs. First, one or more tumors from a variety of patients are staged according to procedures well known in the art, and the expression levels of one or more OSNAs or OSPs is determined for each stage to obtain a standard expression level for each OSNA and OSP. Then, the OSNA or OSP expression levels of the OSNA or OSP are determined in a biological sample from a patient whose stage of cancer is not known. The OSNA or OSP expression levels from the patient are then compared to the standard expression level. By comparing the expression level of the OSNAs and OSPs from the patient to the standard expression levels, one may determine the stage of the tumor. The same procedure may be followed using structural alterations of a OSNA or OSP to determine the stage of a ovarian cancer.

Monitoring

Further provided is a method of monitoring ovarian cancer in a human patient One may monitor a human patient to determine whether there has been metastasis and, if there has been, when metastasis began to occur. One may also monitor a human patient to determine whether a preneoplastic lesion has become cancerous. One may also monitor a human patient to determine whether a therapy, e.g., chemotherapy, radiotherapy or surgery, has decreased or eliminated the ovarian cancer. The monitoring may determine if there has been a reoccurrence and, if so, determine its nature. The method comprises identifying a human patient that one wants to monitor for ovarian cancer, periodically analyzing cells, tissues or bodily fluids from such human patient for expression levels of one or more OSNAs or OSPs; and comparing the OSNA or OSP levels over time to those OSNA or OSP expression levels obtained previously. Patients may also be monitored by measuring one or more structural alterations in a OSNA or OSP that are associated with ovarian cancer.

If increased expression of a OSNA or OSP is associated with metastasis, treatment failure, or conversion of a preneoplastic lesion to a cancerous lesion, then detecting an increase in the expression level of a OSNA or OSP indicates that the tumor is metastasizing, that treatment has failed or that the lesion is cancerous, respectively. One having ordinary skill in the art would recognize that if this were the case, then a decreased expression level would be indicative of no metastasis, effective therapy or failure to progress to a neoplastic lesion. If decreased expression of a OSNA or OSP is associated with metastasis, treatment failure, or conversion of a preneoplastic lesion to a cancerous lesion, then detecting a decrease in the expression level of a OSNA or OSP indicates that the tumor is metastasizing, that treatment has failed or that the lesion is cancerous, respectively. In a preferred embodiment, the levels of OSNAs or OSPs are determined from the same cell type, tissue or bodily fluid as prior patient samples. Monitoring a patient for onset of ovarian cancer metastasis is periodic and preferably is done on a quarterly basis, but may be done more or less frequently.

The methods described herein can further be utilized as prognostic assays to identify subjects having or at risk of developing a disease or disorder associated with increased or decreased expression levels of a OSNA and/or OSP. The present invention provides a method in which a test sample is obtained from a human patient and one or more OSNAs and/or OSPs are detected. The presence of higher (or lower) OSNA or OSP levels as compared to normal human controls is diagnostic for the human patient being at risk for developing cancer, particularly ovarian cancer. The effectiveness of therapeutic agents to decrease (or increase) expression or activity of one or more OSNAs and/or OSPs of the invention can also be monitored by analyzing levels of expression of the OSNAs and/or OSPs in a human patient in clinical trials or in in vitro screening assays such as in human cells. In this way, the gene expression pattern can serve as a marker, indicative of the physiological response of the human patient or cells, as the case may be, to the agent being tested.

Detection of Genetic Lesions or Mutations

The methods of the present invention can also be used to detect genetic lesions or mutations in a OSG, thereby determining if a human with the genetic lesion is susceptible to developing ovarian cancer or to determine what genetic lesions are responsible, or are partly responsible, for a person's existing ovarian cancer. Genetic lesions can be detected, for example, by ascertaining the existence of a deletion, insertion and/or substitution of one or more nucleotides from the OSGs of this invention, a chromosomal rearrangement of a OSG, an aberrant modification of a OSG (such as of the methylation pattern of the genomic DNA), or allelic loss of a OSG. Methods to detect such lesions in the OSG of this invention are known to those having ordinary skill in the art following the teachings of the specification.

Methods of Detecting Noncancerous Ovarian Diseases

The present invention also provides methods for determining the expression levels and/or structural alterations of one or more OSNAs and/or OSPs in a sample from a patient suspected of having or known to have a noncancerous ovarian disease. In general, the method comprises the steps of obtaining a sample from the patient, determining the expression level or structural alterations of a OSNA and/or OSP, comparing the expression level or structural alteration of the OSNA or OSP to a normal ovarian control, and then ascertaining whether the patient has a noncancerous ovarian disease. In general, if high expression relative to a control of a OSNA or OSP is indicative of a particular noncancerous ovarian disease, a diagnostic assay is considered positive if the level of expression of the OSNA or OSP is at least two times higher, and more preferably are at least five times higher, even more preferably at least ten times higher, than in preferably the same cells, tissues or bodily fluid of a normal human control. In contrast, if low expression relative to a control of a OSNA or OSP is indicative of a noncancerous ovarian disease, a diagnostic assay is considered positive if the level of expression of the OSNA or OSP is at least two times lower, more preferably are at least five times lower, even more preferably at least ten times lower than in preferably the same cells, tissues or bodily fluid of a normal human control. The normal human control may be from a different patient or from uninvolved tissue of the same patient.

One having ordinary skill in the art may determine whether a OSNA and/or OSP is associated with a particular noncancerous ovarian disease by obtaining ovarian tissue from a patient having a noncancerous ovarian disease of interest and determining which OSNAs and/or OSPs are expressed in the tissue at either a higher or a lower level than in normal ovarian tissue. In another embodiment, one may determine whether a OSNA or OSP exhibits structural alterations in a particular noncancerous ovarian disease state by obtaining ovarian tissue from a patient having a noncancerous ovarian disease of interest and determining the structural alterations in one or more OSNAs and/or OSPs relative to normal ovarian tissue.

Methods for Identifying Ovarian Tissue

In another aspect, the invention provides methods for identifying ovarian tissue. These methods are particularly useful in, e.g., forensic science, ovarian cell differentiation and development, and in tissue engineering.

In one embodiment, the invention provides a method for determining whether a sample is ovarian tissue or has ovarian tissue-like characteristics. The method comprises the steps of providing a sample suspected of comprising ovarian tissue or having ovarian tissue-like characteristics, determining whether the sample expresses one or more OSNAs and/or OSPs, and, if the sample expresses one or more OSNAs and/or OSPs, concluding that the sample comprises ovarian tissue. In a preferred embodiment, the OSNA encodes a polypeptide having an amino acid sequence selected from SEQ ID NO: 249-396, or a homolog, allelic variant or fragment thereof. In a more preferred embodiment, the OSNA has a nucleotide sequence selected from SEQ ID NO: 1-248, or a hybridizing nucleic acid, an allelic variant or a part thereof. Determining whether a sample expresses a OSNA can be accomplished by any method known in the art. Preferred methods include hybridization to microarrays, Northern blot hybridization, and quantitative or qualitative RT-PCR. In another preferred embodiment, the method can be practiced by determining whether a OSP is expressed. Determining whether a sample expresses a OSP can be accomplished by any method known in the art. Preferred methods include Western blot, ELISA, RIA and 2D PAGE. In one embodiment, the OSP has an amino acid sequence selected from SEQ ID NO: 249-396, or a homolog, allelic variant or fragment thereof. In another preferred embodiment, the expression of at least two OSNAs and/or OSPs is determined. In a more preferred embodiment, the expression of at least three, more preferably four and even more preferably five OSNAs and/or OSPs are determined.

In one embodiment, the method can be used to determine whether an unknown tissue is ovarian tissue. This is particularly useful in forensic science, in which small, damaged pieces of tissues that are not identifiable by microscopic or other means are recovered from a crime or accident scene. In another embodiment, the method can be used to determine whether a tissue is differentiating or developing into ovarian tissue. This is important in monitoring the effects of the addition of various agents to cell or tissue culture, e.g., in producing new ovarian tissue by tissue engineering. These agents include, e.g., growth and differentiation factors, extracellular matrix proteins and culture medium. Other factors that may be measured for effects on tissue development and differentiation include gene transfer into the cells or tissues, alterations in pH, aqueous:air interface and various other culture conditions.

Methods for Producing and Modifying Ovarian Tissue

In another aspect, the invention provides methods for producing engineered ovarian tissue or cells. In one embodiment, the method comprises the steps of providing cells, introducing a OSNA or a OSG into the cells, and growing the cells under conditions in which they exhibit one or more properties of ovarian tissue cells. In a preferred embodiment, the cells are pleuripotent. As is well known in the art, normal ovarian tissue comprises a large number of different cell types. Thus, in one embodiment, the engineered ovarian tissue or cells comprises one of these cell types. In another embodiment, the engineered ovarian tissue or cells comprises more than one ovarian cell type. Further, the culture conditions of the cells or tissue may require manipulation in order to achieve full differentiation and development of the ovarian cell tissue. Methods for manipulating culture conditions are well known in the art.

Nucleic acid molecules encoding one or more OSPs are introduced into cells, preferably pleuripotent cells. In a preferred embodiment, the nucleic acid molecules encode OSPs having amino acid sequences selected from SEQ ID NO: 249-396, or homologous proteins, analogs, allelic variants or fragments thereof. In a more preferred embodiment, the nucleic acid molecules have a nucleotide sequence selected from SEQ ID NO: 1-248, or hybridizing nucleic acids, allelic variants or parts thereof. In another highly preferred embodiment, a OSG is introduced into the cells. Expression vectors and methods of introducing nucleic acid molecules into cells are well known in the art and are described in detail, supra.

Artificial ovarian tissue may be used to treat patients who have lost some or all of their ovarian function.

Pharmaceutical Compositions

In another aspect, the invention provides pharmaceutical compositions comprising the nucleic acid molecules, polypeptides, fusion proteins, antibodies, antibody derivatives, antibody fragments, agonists, antagonists, or inhibitors of the present invention. In a preferred embodiment, the pharmaceutical composition comprises a OSNA or part thereof. In a more preferred embodiment, the OSNA has a nucleotide sequence selected from the group consisting of SEQ ID NO: 1-248, a nucleic acid that hybridizes thereto, an allelic variant thereof, or a nucleic acid that has substantial sequence identity thereto. In another preferred embodiment, the pharmaceutical composition comprises a OSP or fragment thereof. In a more preferred embodiment, the pharmaceutical composition comprises a OSP having an amino acid sequence that is selected from the group consisting of SEQ ID NO: 249-396, a polypeptide that is homologous thereto, a fusion protein comprising all or a portion of the polypeptide, or an analog or derivative thereof. In another preferred embodiment, the pharmaceutical composition comprises an anti-OSP antibody, preferably an antibody that specifically binds to a OSP having an amino acid that is selected from the group consisting of SEQ ID NO: 249-396, or an antibody that binds to a polypeptide that is homologous thereto, a fusion protein comprising all or a portion of the polypeptide, or an analog or derivative thereof.

Such a composition typically contains from about 0.1 to 90% by weight of a therapeutic agent of the invention formulated in and/or with a pharmaceutically acceptable carrier or excipient.

Pharmaceutical formulation is a well-established art that is further described in Gennaro (ed.), Remington: The Science and Practice of Pharmacy, 20$^{th}$ ed.; Lippincott, Williams & Wilkins (2000); Ansel et al., Pharmaceutical Dosage Forms and Drug Delivery Systems, 7$^{th}$ ed., Lippincott Williams & Wilkins (1999); and Kibbe (ed.), Handbook of Pharmaceutical Excipients American Pharmaceutical Association, 3$^{rd}$ ed. (2000) and thus need not be described in detail herein.

Briefly, formulation of the pharmaceutical compositions of the present invention will depend upon the route chosen for administration. The pharmaceutical compositions utilized in this invention can be administered by various routes including both enteral and parenteral routes, including oral, intravenous, intramuscular, subcutaneous, inhalation, topical, sublingual, rectal, intra-arterial, intramedullary, intrathecal, intraventricular, transmucosal, transdermal, intranasal, intraperitoneal, intrapulmonary, and intrauterine.

Oral dosage forms can be formulated as tablets, pills, dragees, capsules, liquids, gels, syrups, slurries, suspensions, and the like, for ingestion by the patient.

Solid formulations of the compositions for oral administration can contain suitable carriers or excipients, such as carbohydrate or protein fillers, such as sugars, including lactose, sucrose, mannitol, or sorbitol; starch from corn, wheat, rice, potato, or other plants; cellulose, such as methyl cellulose, hydroxypropylmethyl-cellulose, sodium carboxymethylcellulose, or microcrystalline cellulose; gums including arabic and tragacanth; proteins such as gelatin and collagen; inorganics, such as kaolin, calcium carbonate, dicalcium phosphate, sodium chloride; and other agents such as acacia and alginic acid.

Agents that facilitate disintegration and/or solubilization can be added, such as the cross-linked polyvinyl pyrrolidone, agar, alginic acid, or a salt thereof, such as sodium alginate, microcrystalline cellulose, cornstarch, sodium starch glycolate, and alginic acid.

Tablet binders that can be used include acacia, methylcellulose, sodium carboxymethylcellulose, polyvinylpyrrolidone (Povidone™), hydroxypropyl methylcellulose, sucrose, starch and ethylcellulose.

Lubricants that can be used include magnesium stearates, stearic acid, silicone fluid, talc, waxes, oils, and colloidal silica.

Fillers, agents that facilitate disintegration and/or solubilization, tablet binders and lubricants, including the aforementioned, can be used singly or in combination.

Solid oral dosage forms need not be uniform throughout. For example, dragee cores can be used in conjunction with suitable coatings, such as concentrated sugar solutions, which can also contain gum arabic, talc, polyvinylpyrrolidone, carbopol gel, polyethylene glycol, and/or titanium dioxide, lacquer solutions, and suitable organic solvents or solvent mixtures.

Oral dosage forms of the present invention include push-fit capsules made of gelatin, as well as soft, sealed capsules made of gelatin and a coating, such as glycerol or sorbitol. Push-fit capsules can contain active ingredients mixed with a filler or binders, such as lactose or starches, lubricants, such as talc or magnesium stearate, and, optionally, stabilizers. In soft capsules, the active compounds can be dissolved or suspended in suitable liquids, such as fatty oils, liquid, or liquid polyethylene glycol with or without stabilizers.

Additionally, dyestuffs or pigments can be added to the tablets or dragee coatings for product identification or to characterize the quantity of active compound, i.e., dosage.

Liquid formulations of the pharmaceutical compositions for oral (enteral) administration are prepared in water or other aqueous vehicles and can contain various suspending agents such as methylcellulose, alginates, tragacanth, pectin, kelgin, carrageenan, acacia, polyvinylpyrrolidone, and polyvinyl alcohol. The liquid formulations can also include solutions, emulsions, syrups and elixirs containing, together with the active compound(s), wetting agents, sweeteners, and coloring and flavoring agents.

The pharmaceutical compositions of the present invention can also be formulated for parenteral administration. Formulations for parenteral administration can be in the form of aqueous or non-aqueous isotonic sterile injection solutions or suspensions.

For intravenous injection, water soluble versions of the compounds of the present invention are formulated in, or if provided as a lyophilate, mixed with, a physiologically acceptable fluid vehicle, such as 5% dextrose ("D5"), physiologically buffered saline, 0.9% saline, Hanks' solution, or Ringer's solution. Intravenous formulations may include carriers, excipients or stabilizers including, without limitation, calcium, human serum albumin, citrate, acetate, calcium chloride, carbonate, and other salts.

Intramuscular preparations, e.g. a sterile formulation of a suitable soluble salt form of the compounds of the present invention, can be dissolved and administered in a pharmaceutical excipient such as Water-for-Injection, 0.9% saline, or 5% glucose solution. Alternatively, a suitable insoluble form of the compound can be prepared and administered as a suspension in an aqueous base or a pharmaceutically acceptable oil base, such as an ester of a long chain fatty acid (e.g., ethyl oleate), fatty oils such as sesame oil, triglycerides, or liposomes.

Parenteral formulations of the compositions can contain various carriers such as vegetable oils, dimethylacetamide, dimethylformamide, ethyl lactate, ethyl carbonate, isopropyl myristate, ethanol, polyols (glycerol, propylene glycol, liquid polyethylene glycol, and the like).

Aqueous injection suspensions can also contain substances that increase the viscosity of the suspension, such as sodium carboxymethyl cellulose, sorbitol, or dextran. Non-lipid polycationic amino polymers can also be used for delivery. Optionally, the suspension can also contain suitable stabilizers or agents that increase the solubility of the compounds to allow for the preparation of highly concentrated solutions.

Pharmaceutical compositions of the present invention can also be formulated to permit injectable, long-term, deposition. Injectable depot forms may be made by forming microencapsulated matrices of the compound in biodegradable polymers such as polylactide-polyglycolide. Depending upon the ratio of drug to polymer and the nature of the particular polymer employed, the rate of drug release can be controlled. Examples of other biodegradable polymers include poly(orthoesters) and poly(anhydrides). Depot injectable formulations are also prepared by entrapping the drug in microemulsions that are compatible with body tissues.

The pharmaceutical compositions of the present invention can be administered topically. For topical use the compounds of the present invention can also be prepared in suitable forms to be applied to the skin, or mucus membranes of the nose and throat, and can take the form of lotions, creams, ointments, liquid sprays or inhalants, drops, tinctures, lozenges, or throat paints. Such topical formulations further can include chemical compounds such as dimethylsulfoxide (DMSO) to facilitate surface penetration of the active ingredient. In other transdermal formulations; typically in patch-delivered formulations, the pharmaceutically active compound is formulated with one or more skin penetrants, such as 2-N-methyl-pyrrolidone (NMP) or Azone. A topical semi-solid ointment formulation typically contains a concentration of the active ingredient from about 1 to 20%, e.g., 5 to 10%, in a carrier such as a pharmaceutical cream base.

For application to the eyes or ears, the compounds of the present invention can be presented in liquid or semi-liquid form formulated in hydrophobic or hydrophilic bases as ointments, creams, lotions, paints or powders.

For rectal administration the compounds of the present invention can be administered in the form of suppositories admixed with conventional carriers such as cocoa butter, wax or other glyceride.

Inhalation formulations can also readily be formulated. For inhalation, various powder and liquid formulations can be prepared. For aerosol preparations, a sterile formulation of the compound or salt form of the compound may be used in inhalers, such as metered dose inhalers, and nebulizers. Aerosolized forms may be especially useful for treating respiratory disorders.

Alternatively, the compounds of the present invention can be in powder form for reconstitution in the appropriate pharmaceutically acceptable carrier at the time of delivery.

The pharmaceutically active compound in the pharmaceutical compositions of the present invention can be provided as the salt of a variety of acids, including but not limited to hydrochloric, sulfuric, acetic, lactic, tartaric, malic, and succinic acid. Salts tend to be more soluble in aqueous or other protonic solvents than are the corresponding free base forms.

After pharmaceutical compositions have been prepared, they are packaged in an appropriate container and labeled for treatment of an indicated condition.

The active compound will be present in an amount effective to achieve the intended purpose. The determination of an effective dose is well within the capability of those skilled in the art.

A "therapeutically effective dose" refers to that amount of active ingredient, for example OSP polypeptide, fusion protein, or fragments thereof, antibodies specific for OSP, agonists, antagonists or inhibitors of OSP, which ameliorates the signs or symptoms of the disease or prevent progression thereof; as would be understood in the medical arts, cure, although desired, is not required.

The therapeutically effective dose of the pharmaceutical agents of the present invention can be estimated initially by in vitro tests, such as cell culture assays, followed by assay in model animals, usually mice, rats, rabbits, dogs, or pigs. The animal model can also be used to determine an initial preferred concentration range and route of administration.

For, example, the ED50 (the dose therapeutically effective in 50% of the population) and LD50 (the dose lethal to 50% of the population) can be determined in one or more cell culture of animal model systems. The dose ratio of toxic to therapeutic effects is the therapeutic index, which can be expressed as LD50/ED50. Pharmaceutical compositions that exhibit large therapeutic indices are preferred.

The data obtained from cell culture assays and animal studies are used in formulating an initial dosage range for human use, and preferably provide a range of circulating concentrations that includes the ED50 with little or no toxicity. After administration, or between successive administrations, the circulating concentration of active agent varies within this range depending upon pharmacokinetic factors well known in the art, such as the dosage form employed, sensitivity of the patient, and the route of administration.

The exact dosage will be determined by the practitioner, in light of factors specific to the subject requiring treatment. Factors that can be taken into account by the practitioner include the severity of the disease state, general health of the subject, age, weight, gender of the subject, diet, time and frequency of administration, drug combination(s), reaction sensitivities, and tolerance/response to therapy. Long-acting pharmaceutical compositions can be administered every 3 to 4 days, every week, or once every two weeks depending on half-life and clearance rate of the particular formulation.

Normal dosage amounts may vary from 0.1 to 100,000 micrograms, up to a total dose of about 1 g, depending upon the route of administration. Where the therapeutic agent is a protein or antibody of the present invention, the therapeutic protein or antibody agent typically is administered at a daily dosage of 0.01 mg to 30 mg/kg of body weight of the patient (e.g., 1 mg/kg to 5 mg/kg). The pharmaceutical formulation can be administered in multiple doses per day, if desired, to achieve the total desired daily dose.

Guidance as to particular dosages and methods of delivery is provided in the literature and generally available to practitioners in the art. Those skilled in the art will employ different formulations for nucleotides than for proteins or their inhibitors. Similarly, delivery of polynucleotides or polypeptides will be specific to particular cells, conditions, locations, etc.

Conventional methods, known to those of ordinary skill in the art of medicine, can be used to administer the pharmaceutical formulation(s) of the present invention to the patient. The pharmaceutical compositions of the present invention can be administered alone, or in combination with other therapeutic agents or interventions.

Therapeutic Methods

The present invention further provides methods of treating subjects having defects in a gene of the invention, e.g., in expression, activity, distribution, localization, and/or solubility, which can manifest as a disorder of ovarian function. As used herein, "treating" includes all medically-acceptable types of therapeutic intervention, including palliation and prophylaxis (prevention) of disease. The term "treating" encompasses any improvement of a disease, including minor improvements. These methods are discussed below.

Gene Therapy and Vaccines

The isolated nucleic acids of the present invention can also be used to drive in vivo expression of the polypeptides of the present invention. In vivo expression can be driven from a vector, typically a viral vector, often a vector based upon a replication incompetent retrovirus, an adenovirus, or an adeno-associated virus (AAV), for the purpose of gene therapy. In vivo expression can also be driven from signals endogenous to the nucleic acid or from a vector, often a plasmid vector, such as pVAX1 (Invitrogen, Carlsbad, Calif., USA), for purpose of "naked" nucleic acid vaccination, as further described in U.S. Pat. Nos. 5,589,466; 5,679,647; 5,804,566; 5,830,877; 5,843,913; 5,880,104; 5,958,891; 5,985,847; 6,017,897; 6,110,898; 6,204,250, the disclosures of which are incorporated herein by reference in their entireties. For cancer therapy, it is preferred that the vector also be tumor-selective. See, e.g., Doronin et al., *J. Virol.* 75: 3314-24 (2001).

In another embodiment of the therapeutic methods of the present invention, a therapeutically effective amount of a pharmaceutical composition comprising a nucleic acid molecule of the present invention is administered. The nucleic acid molecule can be delivered in a vector that drives expression of a OSP, fusion protein, or fragment thereof, or without such vector. Nucleic acid compositions that can drive expression of a OSP are administered, for example, to complement a deficiency in the native OSP, or as DNA vaccines. Expression vectors derived from virus, replication deficient retroviruses, adenovirus, adeno-associated (AAV) virus, herpes virus, or vaccinia virus can be used as can plasmids. See, e.g., Cid-Arregui, supra. In a preferred embodiment, the nucleic acid molecule encodes a OSP having the amino acid sequence of SEQ ID NO: 249-396, or a fragment, fusion protein, allelic variant or homolog thereof.

In still other therapeutic methods of the present invention, pharmaceutical compositions comprising host cells that express a OSP, fusions, or fragments thereof can be administered. In such cases, the cells are typically autologous, so as to circumvent xenogeneic or allotypic rejection, and are administered to complement defects in OSP production or activity. In a preferred embodiment, the nucleic acid molecules in the cells encode a OSP having the amino acid sequence of SEQ ID NO: 249-396, or a fragment, fusion protein, allelic variant or homolog thereof.

Antisense Administration

Antisense nucleic acid compositions, or vectors that drive expression of a OSG antisense nucleic acid, are administered to downregulate transcription and/or translation of a OSG in circumstances in which excessive production, or production of aberrant protein, is the pathophysiologic basis of disease.

Antisense compositions useful in therapy can have a sequence that is complementary to coding or to noncoding regions of a OSG. For example, oligonucleotides derived from the transcription initiation site, e.g., between positions −10 and +10 from the start site, are preferred.

Catalytic antisense compositions, such as ribozymes, that are capable of sequence-specific hybridization to OSG transcripts, are also useful in therapy. See, e.g., Phylactou, *Adv. Drug Deliv. Rev.* 44(2-3): 97-108 (2000); Phylactou et al., *Heinz. Mol. Genet.* 7(10): 1649-53 (1998); Rossi, *Ciba Found. Symp.* 209: 195-204 (1997); and Sigurdsson et al., *Trends Biotechnol.* 13(8): 286-9 (1995).

Other nucleic acids useful in the therapeutic methods of the present invention are those that are capable of triplex helix formation in or near the OSG genomic locus. Such triplexing oligonucleotides are able to inhibit transcription. See, e.g., Intody et al, *Nucleic Acids Res.* 28(21): 4283-90 (2000); and McGuffie et al., *Cancer Res.* 60(14): 3790-9 (2000). Pharmaceutical compositions comprising such triplex forming oligos (TFOs) are administered in circumstances in which excessive production, or production of aberrant protein, is a pathophysiologic basis of disease.

In a preferred embodiment, the antisense molecule is derived from a nucleic acid molecule encoding a OSP, preferably a OSP comprising an amino acid sequence of SEQ ID NO: 249-396, or a fragment, allelic variant or homolog thereof. In a more preferred embodiment, the antisense molecule is derived from a nucleic acid molecule having a nucleotide sequence of SEQ ID NO: 1-248, or a part, allelic variant, substantially similar or hybridizing nucleic acid thereof.

Polypeptide Administration

In one embodiment of the therapeutic methods of the present invention, a therapeutically effective amount of a pharmaceutical composition comprising a OSP, a fusion protein, fragment, analog or derivative thereof is administered to a subject with a clinically-significant OSP defect Protein compositions are administered, for example, to complement a deficiency in native OSP. In other embodiments, protein compositions are administered as a vaccine to elicit a humoral and/or cellular immune response to OSP. The immune response can be used to modulate activity of OSP or, depending on the immunogen, to immunize against aberrant or aberrantly expressed forms, such as mutant or inappropriately expressed isoforms. In yet other embodiments, protein fusions having a toxic moiety are administered to ablate cells that aberrantly accumulate OSP.

In a preferred embodiment, the polypeptide administered is a —OSP comprising an amino acid sequence of SEQ ID NO: 249-396, or a fusion protein, allelic variant, homolog, analog or derivative thereof. In a more preferred embodiment, the polypeptide is encoded by a nucleic acid molecule having a nucleotide sequence of SEQ ID NO: 1-248, or a part, allelic variant, substantially similar or hybridizing nucleic acid thereof.

Antibody, Agonist and Antagonist Administration

In another embodiment of the therapeutic methods of the present invention, a therapeutically effective amount of a pharmaceutical composition comprising an antibody (including fragment or derivative thereof) of the present invention is administered. As is well known, antibody compositions are administered, for example, to antagonize activity of OSP, or to target therapeutic agents to sites of OSP presence and/or accumulation. In a preferred embodiment, the antibody specifically binds to a OSP comprising an amino acid sequence of SEQ ID NO: 249-396, or a fusion protein, allelic variant, homolog, analog or derivative thereof. In a more preferred embodiment, the antibody specifically binds to a OSP encoded by a nucleic acid molecule having a nucleotide sequence of SEQ ID NO: 1-248, or a part, allelic variant, substantially similar or hybridizing nucleic acid thereof.

The present invention also provides methods for identifying modulators which bind to a OSP or have a modulatory effect on the expression or activity of a OSP. Modulators which decrease the expression or activity of OSP (antagonists) are believed to be useful in treating ovarian cancer. Such screening assays are known to those of skill in the art and include, without limitation, cell-based assays and cell-free assays. Small molecules predicted via computer imaging to specifically bind to regions of a OSP can also be designed, synthesized and tested for use in the imaging and treatment of ovarian cancer. Further, libraries of molecules can be screened for potential anticancer agents by assessing the ability of the molecule to bind to the OSPs identified herein. Molecules identified in the library as being capable of binding to a OSP are key candidates for further evaluation for use in the treatment of ovarian cancer. In a preferred embodiment, these molecules will downregulate expression and/or activity of a OSP in cells.

In another embodiment of the therapeutic methods of the present invention, a pharmaceutical composition comprising a non-antibody antagonist of OSP is administered. Antagonists of OSP can be produced using methods generally known in the art. In particular, purified OSP can be used to screen libraries of pharmaceutical agents, often combinatorial libraries of small molecules, to identify those that specifically bind and antagonize at least one activity of a OSP.

In other embodiments a pharmaceutical composition comprising an agonist of a OSP is administered. Agonists can be identified using methods analogous to those used to identify antagonists.

In a preferred embodiment, the antagonist or agonist specifically binds to and antagonizes or agonizes, respectively, a OSP comprising an amino acid sequence of SEQ ID NO: 249-396, or a fusion protein, allelic variant, homolog, analog or derivative thereof. In a more preferred embodiment, the antagonist or agonist specifically binds to and antagonizes or agonizes, respectively, a OSP encoded by a nucleic acid molecule having a nucleotide sequence of SEQ ID NO: 1-248, or a part, allelic variant, substantially similar or hybridizing nucleic acid thereof.

Targeting Ovarian Tissue

The invention also provides a method in which a polypeptide of the invention, or an antibody thereto, is linked to a therapeutic agent such that it can be delivered to the ovarian or to specific cells in the ovarian. In a preferred embodiment, an anti-OSP antibody is linked to a therapeutic agent and is administered to a patient in need of such therapeutic agent. The therapeutic agent may be a toxin, if ovarian tissue needs to be selectively destroyed. This would be useful for targeting and killing ovarian cancer cells. In another embodiment, the therapeutic agent may be a growth or differentiation factor, which would be useful for promoting ovarian cell function.

In another embodiment, an anti-OSP antibody may be linked to an imaging agent that can be detected using, e.g., magnetic resonance imaging, CT or PET. This would be useful for determining and monitoring ovarian function, identifying ovarian cancer tumors, and identifying noncancerous ovarian diseases.

EXAMPLES

Example 1a

Gene Expression Analysis

Identification of OSGs was carried out by a systematic analysis of gene expression data in the LIFESEQ® Gold database available from Incyte Genomics Inc, Palo Alto, Calif., using the data mining software package CLASP™.

The CLASP target gene identification process is focused on, but not limited to, the following 5 CLASP profiles: tissue specific expression, cancer specific expression, differentially expressed in cancer, maximum tissue differential expression.

1. For these profiles: cDNA libraries were divided into 60 unique tissue organs. The genes were grouped into gene bins, each bin is a sequence based cluster grouped together with a common contig. The expression levels for each gene bin were calculated in each organ. Differential expression significance was calculated with rigorous statistical significant test considering the influence of sequence random fluctuations and sampling size of cDNA libraries from concept published by Audic S and Claverie J M (Genome Res 1997 7(10): 986-995: The significance of digital gene expression profiles).
2. Highly expressed organ specific genes were selected based on the percentage abundance level in the targeted organ versus all the other organs (organ-specificity).
3. The expression levels of each highly expressed organ-specific gene in the tumor tissue libraries were compared with normal tissue libraries and tissue libraries associated with tumor or disease (cancer-specificity) and analyzed for statistical significance.
4. Target genes exhibiting each CLASP profile criteria were selected.

CLASP 1 tissue specific expression profile: In order to meet the organ-specificity criteria, the expression level of the component clones which the gene is composed of must exhibit three or more occurrences regardless the total number of genes isolated for the target organ. The percentage abundance-level in each organ was calculated to identify the organ with the highest expression percentage level.

CLASP 2 cancer specific expression profile: In order to fulfill the cancer specific criteria, genes must exhibit zero expression in normal libraries and measurable expression in libraries associated with tumor and/or disease. The gene must also exhibit organ-specificity to be selected as a CLASP target for this profile.

CLASP 3 maximum tissue differential expression profile: CLASP targets were selected based on ratio of expression in tumor libraries compared to expression in normal libraries (including normal libraries associated with tumor or disease) for each organ regardless of whether the gene exhibited organ-specificity. This profile was divided into 2 sub-profiles, since the ratio of expression cannot be obtained if no expression is present in normal libraries (including normal libraries associated with tumor or disease). In this case, the maximum expression percentage of the gene was calculated by measuring the occurrence of the gene divided by the occurrence of all genes in the target organ. CLASP selects the top 50 targets for each sub-profile.

CLASP 4 maximum tissue differential expression profile with negligible expression in normal tissues: CLASP targets were selected based on ratio of expression in tumor libraries compared to expression in normal libraries (including normal libraries associated with tumor or disease) for each organ regardless of whether the gene exhibited organ-specificity.

CLASP 5 differentially expressed in cancer profile: Expression levels in tumor libraries in each organ and normal libraries (including normal libraries associated with cancer or disease) for all organs were obtained and statistically analyzed. If the gene exhibited 90% of confidence that it is over-expressed in tumor libraries in the target organ than normal libraries for all organs, it was selected as a CLASP target for this profile.

Accordingly, CLASP allows the identification of highly expressed organ and cancer specific genes based on the gene expression levels in each tissue organ. CLASP scores for a portion of the OSG of this invention are listed below.

| DEX0337_X | CLASP |
|---|---|
| DEX0337_1 | CLASP5 CLASP3 |
| DEX0337_2 | CLASP5 CLASP4 |
| DEX0337_3 | CLASP5 CLASP3 |
| DEX0337_4 | CLASP5 CLASP3 |
| DEX0337_5 | CLASP5 |
| DEX0337_6 | CLASP5 |
| DEX0337_7 | CLASP5 |
| DEX0337_8 | CLASP5 |
| DEX0337_9 | CLASP5 |
| DEX0337_10 | CLASP5 |
| DEX0337_13 | CLASP5 |
| DEX0337_14 | CLASP5 |
| DEX0337_15 | CLASP5 |
| DEX0337_16 | CLASP5 |
| DEX0337_17 | CLASP5 |
| DEX0337_18 | CLASP5 |
| DEX0337_19 | CLASP5 |
| DEX0337_20 | CLASP5 |
| DEX0337_21 | CLASP5 |
| DEX0337_24 | CLASP5 |
| DEX0337_25 | CLASP5 |
| DEX0337_26 | CLASP5 CLASP4 CLASP3 |
| DEX0337_30 | CLASP5 |
| DEX0337_31 | CLASP5 |
| DEX0337_32 | CLASP5 CLASP4 |

-continued

| DEX0337_X | CLASP |
|---|---|
| DEX0337_33 | CLASP5 |
| DEX0337_34 | CLASP5 CLASP4 |
| DEX0337_35 | CLASP5 CLASP4 |
| DEX0337_36 | CLASP5 CLASP4 |
| DEX0337_37 | CLASP5 CLASP4 |
| DEX0337_38 | CLASP5 CLASP4 |
| DEX0337_39 | CLASP5 CLASP4 |
| DEX0337_40 | CLASP5 |
| DEX0337_41 | CLASP5 |
| DEX0337_42 | CLASP5 CLASP3 |
| DEX0337_43 | CLASP5 |
| DEX0337_44 | CLASP5 |
| DEX0337_45 | CLASP5 CLASP4 |
| DEX0337_46 | CLASP5 CLASP4 |
| DEX0337_47 | CLASP5 CLASP4 |
| DEX0337_48 | CLASP5 CLASP1 CLASP3 CLASP4 |
| DEX0337_49 | CLASP5 CLASP3 CLASP4 |
| DEX0337_50 | CLASP5 CLASP3 CLASP4 |
| DEX0337_51 | CLASP5 |
| DEX0337_52 | CLASP5 |
| DEX0337_53 | CLASP5 |
| DEX0337_54 | CLASP5 |
| DEX0337_55 | CLASP5 |
| DEX0337_56 | CLASP5 |
| DEX0337_57 | CLASP5 |

-continued

| DEX0337_X | CLASP |
|---|---|
| DEX0337_60 | CLASP5 |
| DEX0337_61 | CLASP5 |
| DEX0337_62 | CLASP5 |
| DEX0337_63 | CLASP5 |
| DEX0337_64 | CLASP5 |
| DEX0337_65 | CLASP5 CLASP1 CLASP3 CLASP4 |
| DEX0337_66 | CLASP5 |
| DEX0337_67 | CLASP5 |
| DEX0337_68 | CLASP5 |
| DEX0337_69 | CLASP5 CLASP4 |
| DEX0337_70 | CLASP5 |
| DEX0337_71 | CLASP5 |
| DEX0337_72 | CLASP5 CLASP3 |
| DEX0337_73 | CLASP5 CLASP3 |
| DEX0337_74 | CLASP5 CLASP4 |
| DEX0337_102 | CLASP2 |
| DEX0337_103 | CLASP2 |
| DEX0337_104 | CLASP2 |
| DEX0337_105 | CLASP2 |

In addition the expression values for each organ in the format 9-0.9999 are listed. Each column first lists the given organ (ORG), a number representing the percentage of the expression (EXP) of the gene in the given organ.

| DEX0337_X | Org Exp | Org Exp | Org Exp | Org Exp | Org Exp |
|---|---|---|---|---|---|
| DEX0337_1 | OVR .2677 | PIB .0363 | FAL .0503 | BMR .0515 | SPC .06 |
| DEX0337_2 | OVR .2339 | MSL .0845 | SAG .0988 | BNC .1085 | UNC .1236 |
| DEX0337_3 | OVR .0021 | BRN .0013 | UTR .0013 | BLD .0016 | BLV .0016 |
| DEX0337_4 | OVR .0021 | BRN .0013 | UTR .0013 | BLD .0016 | BLV .0016 |
| DEX0337_5 | OVR .001 | | | | |
| DEX0337_6 | OVR .001 | | | | |
| DEX0337_7 | OVR .001 | BRN .0002 | | | |
| DEX0337_8 | OVR .001 | CON .0011 | | | |
| DEX0337_9 | OVR .001 | | | | |
| DEX0337_10 | OVR .001 | | | | |
| DEX0337_13 | OVR .001 | | | | |
| DEX0337_14 | OVR .001 | | | | |
| DEX0337_15 | OVR .001 | | | | |
| DEX0337_16 | OVR .001 | | | | |
| DEX0337_17 | OVR .001 | | | | |
| DEX0337_18 | OVR .001 | | | | |
| DEX0337_19 | OVR .001 | | | | |
| DEX0337_20 | OVR .001 | | | | |
| DEX0337_21 | OVR .001 | | | | |
| DEX0337_24 | OVR .0021 | BRN .0002 | | | |
| DEX0337_25 | OVR .0021 | BRN .0002 | | | |
| DEX0337_26 | ESO .0051 | LIV .0076 | LMN .0083 | FAL .0189 | |
| DEX0337_27 | ESO .0051 | LIV .0076 | LMN .0083 | FAL .0189 | |
| DEX0337_28 | OVR .0033 | BRN .0001 | PRO .0003 | MAM .0004 | UTR .0004 |
| DEX0337_29 | OVR .0492 | BRN .0002 | BRN .0002 | CON .0034 | CON .0034 |
| DEX0337_30 | OVR .001 | | | | |
| DEX0337_31 | OVR .001 | | | | |
| DEX0337_32 | OVR .0092 | BLD .0016 | BLV .0016 | LIV .0019 | FTS .002 |
| DEX0337_33 | THY .006 | UTR .0069 | KID .0128 | PRO .0135 | |
| DEX0337_34 | OVR .0133 | MSL .0053 | SYN .0056 | NOS .0073 | UNC .008 |
| DEX0337_35 | OVR .8811 | SAG .316 | NOS .4326 | FAL .4399 | PLE .4486 |
| DEX0337_36 | OVR .8811 | SAG .316 | NOS .4326 | FAL .4399 | PLE .4486 |
| DEX0337_37 | OVR .0564 | INT .015 | NOS .0293 | BMR .0322 | BLO .036 |
| DEX0337_38 | OVR .677 | BMR .1609 | SAG .1778 | SPC .1899 | NOS .198 |
| DEX0337_39 | OVR .0092 | PNS .0023 | LMN .0028 | THY .004 | PAN .0047 |
| DEX0337_40 | CON .0011 | | | | |
| DEX0337_41 | OVR .0636 | BRN .0082 | LNG .0207 | GLB .0231 | BLD .0273 |
| DEX0337_42 | OVR .0144 | BRN .0029 | BLV .0033 | BLO .004 | THY .004 |
| DEX0337_43 | OVR .0092 | UNC .004 | BON .0112 | | |
| DEX0337_44 | OVR .0072 | FTS .0018 | PRO .004 | MAM .0043 | INL .009 |
| DEX0337_45 | OVR .0133 | MSL .0053 | SYN .0056 | NOS .0073 | UNC .008 |
| DEX0337_46 | OVR .0103 | BRN .0006 | BLV .0016 | INL .0019 | CRD .0023 |
| DEX0337_47 | OVR .0103 | BRN .0006 | BLV .0016 | INL .0019 | CRD .0023 |
| DEX0337_48 | OVR .1908 | SAG .0593 | SAG .0593 | SAG .0593 | INT .0798 |

-continued

| DEX0337_X | Org Exp | Org Exp | Org Exp | Org Exp | Org Exp |
|---|---|---|---|---|---|
| DEX0337_49 | OVR .1651 | SPC .02 | SPC .02 | PIT .0205 | PIT .0205 |
| DEX0337_50 | OVR .1651 | SPC .02 | SPC .02 | PIT .0205 | PIT .0205 |
| DEX0337_51 | OVR .0072 | LNG .0011 | KID .0026 | BON .0056 | |
| DEX0337_52 | BRN .0199 | | | | |
| DEX0337_53 | OVR .0031 | | | | |
| DEX0337_54 | OVR .0031 | | | | |
| DEX0337_55 | THY .006 | UTR .0069 | KID .0128 | PRO .0135 | |
| DEX0337_56 | OVR .0051 | ADR .003 | CON .0045 | BRN .0052 | TON .0299 |
| DEX0337_57 | OVR .0698 | BRN .03 | FTS .0374 | MAM .0397 | PAN .0447 |
| DEX0337_60 | OVR .0031 | | | | |
| DEX0337_61 | OVR .001 | | | | |
| DEX0337_62 | OVR .001 | | | | |
| DEX0337_63 | OVR .0062 | FTS .0035 | INS .0048 | ADR .0089 | BON .0112 |
| DEX0337_64 | OVR .0174 | FTS .0023 | PAN .0035 | ESO .0051 | |
| DEX0337_65 | OVR .0328 | TNS .0016 | PNS .0022 | PNS .0023 | PNS .0023 |
| DEX0337_66 | OVR .0062 | CRD .0023 | UNC .004 | STO .0041 | PRO .0073 |
| DEX0337_67 | OVR .0318 | UTR .0307 | CON .034 | | |
| DEX0337_68 | OVR .0195 | LMN .0167 | INL .0186 | NOS .022 | ESO .0256 |
| DEX0337_69 | OVR .8811 | SAG .316 | NOS .4326 | FAL .4399 | PLE .4486 |
| DEX0337_70 | OVR .0328 | | | | |
| DEX0337_71 | OVR .0154 | PNS .0047 | | | |
| DEX0337_72 | OVR .0174 | BLO .004 | ESO .0051 | CON .0057 | ADR .006 |
| DEX0337_73 | OVR .0174 | BLO .004 | ESO .0051 | CON .0057 | ADR .006 |
| DEX0337_74 | OVR .0154 | LNG .0017 | MSL .0026 | TST .0027 | ADR .003 |
| DEX0337_102 | OVR .0046 | | | | |
| DEX0337_103 | OVR .0046 | | | | |
| DEX0337_104 | OVR .0046 | | | | |
| DEX0337_105 | OVR .0046 | | | | |

Abbreviation for tissues:
ADR Adrenal Glands;
BLD Bladder;
BLO Blood;
BLV Blood Vessels;
BMR Bone Marrow;
BNC Bronchi;
BON Bones;
BRN Brain;
CON Connective Tissue;
CRD Heart;
ESO Esophagus;
FAL Fallopian Tubes;
FTS Fetus;
GLB Gallbladder;
INL Intestine, Large;
INS Intestine, Small;
INT Intestine;
KID Kidney;
LIV Liver;
LMN Lymphoid Tissue;
LNG Lung;
MAM Breast;
MSL Muscles;
NOS Nose;
OVR Ovary;
PAN Pancreas;
PIB Pineal Body;
PIT Pituitary Gland;
PLE Pleura;
PNS Penis;
PRO Prostate;
SAG Salivary Glands;
SPC Spinal Cord;
STO Stomach;
SYN Synovial Membranes;
THY Thymus Gland;
TNS Tonsil/Adenoids;
TON Tongue;
TST Testis;
UNC Mixed Tissues;
UTR Uterus

Example 1b

Suppression Subtractive Hybridization (Clontech PCR-SELECT)

Clontech PCR-SELECT is a PCR based subtractive hybridization method designed to selectively enrich for cDNAs corresponding to mRNAs differentially expressed between two mRNA populations (Diatchenko et al, Proc. Natl. Acad. Sci. USA, Vol. 93, pp. 6025-6030, 1996). Clontech PCR-SELECT is a method for enrichment of differentially expressed mRNAs based on a selective amplification. cDNA is prepared from the two mRNA populations which are to be compared (Tester: cDNA population in which the differentially expressed messages are sought and Driver: cDNA population in which the differentially expressed transcripts are absent or low). The tester sample is separated in two parts and different PCR adapters are ligated to the 5' ends. Each tester is separately annealed to excess driver (first annealing) and then pooled and again annealed (second annealing) to excess driver. During the first annealing sequences common to both populations anneal. Additionally the concentration of high and low abundance messages are normalized since annealing is faster for abundant molecules due to the second order kinetics of hybridization. During the second annealing cDNAs unique or overabundant to the tester can anneal together. Such molecules have different adapters at their ends. The addition of additional driver during the second annealing enhances the enrichment of the desired differentially expressed sequences. During subsequent PCR, molecules that have different adapters at each end amplify exponentially. Molecules which have identical adapters, or adapters at only one end, or no adapters (driver sequences) either do not amplify or undergo linear amplification. The end result is enrichment for cDNAs corresponding to differentially expressed messages (unique to the tester or upregulated in the tester). This technique was used to identify transcripts unique to ovarian tissue or messages overexpressed in ovarian cancer. Pairs of matched samples isolated from the same patient, a cancer sample, and the "normal" adjacent tissue from the same tissue type were utilized. The mRNA from the cancer tissue is used as the "tester", and the non-cancer mRNA as a "driver". The non-cancer "driver" is from the same individual and tissue as the cancer sample (Matched). Alternatively, the "driver" can be from a different individual but the same tissue as the tumor sample (unmatched). In some cases mixtures of mRNAs derived from non-cancer tissues types different from the cancer tissue type are also used as "drivers". The last approach allows the identification of transcripts whose expression is specific or upregulated in the cancer tissue type analyzed. Such transcripts may or may not be cancer specific in their expression.

Several subtracted libraries were generated for ovarian tissue. The product of the subtraction experiments was used to generate cDNA libraries. These cDNA libraries contain Expressed Sequence Tags (ESTs) from genes that are ovarian cancer specific, or upregulated in ovarian tissue. Randomized clones picked from each cDNA PCR Select library were sequenced and the genes identified by a systematic analysis of the sequence data against the LIFESEQ Gold database available from Incyte Pharmaceuticals, Palo Alto.

Descriptions of the sequences from subtractions are as follows:

| DEX0337_X |
|---|
| DEX0337_75 |
| DEX0337_76 |
| DEX0337_77 |
| DEX0337_78 |
| DEX0337_79 |
| DEX0337_80 |
| DEX0337_81 |
| DEX0337_82 |
| DEX0337_83 |
| DEX0337_84 |
| DEX0337_85 |
| DEX0337_86 |
| DEX0337_87 |
| DEX0337_88 |
| DEX0337_89 |
| DEX0337_90 |
| DEX0337_91 |
| DEX0337_92 |
| DEX0337_93 |
| DEX0337_94 |
| DEX0337_95 |
| DEX0337_96 |
| DEX0337_97 |
| DEX0337_98 |
| DEX0337_99 |
| DEX0337_100 |
| DEX0337_101 |

The sequence identifications and predicted peptide sequences for each of the targets are listed below:

| DEX0337_X | ID | Predicted Peptide |
|---|---|---|
| DEX0337_1 | mry2111 | |
| DEX0337_2 | mry3521 | DEX0337_106 |
| DEX0337_3 | mry4157 | DEX0337_107 |
| DEX0337_4 | flex mry4157 | DEX0337_108 |
| DEX0337_5 | mry15155 | DEX0337_109 |
| DEX0337_6 | flex mry15155 | |
| DEX0337_7 | mry15229 | DEX0337_110 |
| DEX0337_8 | mry15272 | |
| DEX0337_9 | mry15337 | DEX0337_111 |
| DEX0337_10 | flex mry15337 | |
| DEX0337_11 | mry15382 | DEX0337_112 |
| DEX0337_12 | flex mry15382 | |
| DEX0337_13 | mry15405 | DEX0337_113 |
| DEX0337_14 | flex mry15405 | |
| DEX0337_15 | mry15451 | |
| DEX0337_16 | mry15467 | |
| DEX0337_17 | mry15525 | |
| DEX0337_18 | mry15565 | |
| DEX0337_19 | mry15600 | |
| DEX0337_20 | mry15613 | |
| DEX0337_21 | mry15622 | |
| DEX0337_22 | mry15630 | |
| DEX0337_23 | flex mry15630 | |
| DEX0337_24 | mry15658 | DEX0337_114 |
| DEX0337_25 | flex mry15658 | |
| DEX0337_26 | mry15673 | |
| DEX0337_27 | flex mry15673 | |
| DEX0337_28 | mry15778 | |
| DEX0337_29 | mry15781 | |
| DEX0337_30 | mry15859 | DEX0337_115 |
| DEX0337_31 | flex mry15859 | |
| DEX0337_32 | mry15867 | DEX0337_116 |
| DEX0337_33 | mry15874 | DEX0337_117 |
| DEX0337_34 | mry15985 | DEX0337_118 |
| DEX0337_35 | mry15996 | DEX0337_119 |
| DEX0337_36 | mry15998 | DEX0337_120 |
| DEX0337_37 | mry16007 | DEX0337_121 |
| DEX0337_38 | mry16160 | DEX0337_122 |
| DEX0337_39 | mry16164 | DEX0337_123 |
| DEX0337_40 | flex mry16164 | DEX0337_124 |
| DEX0337_41 | mry16208 | DEX0337_125 |
| DEX0337_42 | mry16281 | DEX0337_126 |

-continued

| DEX0337_X | ID | Predicted Peptide |
|---|---|---|
| DEX0337_43 | mry16285 | |
| DEX0337_44 | mry16315 | DEX0337_127 |
| DEX0337_45 | mry16528 | |
| DEX0337_46 | mry16562 | DEX0337_128 |
| DEX0337_47 | flex mry16562 | DEX0337_129 |
| DEX0337_48 | mry16608 | DEX0337_130 |
| DEX0337_49 | mry16623 | DEX0337_131 |
| DEX0337_50 | flex mry16623 | |
| DEX0337_51 | mry16637 | |
| DEX0337_52 | mry16662 | |
| DEX0337_53 | mry16664 | DEX0337_132 |
| DEX0337_54 | flex mry16664 | |
| DEX0337_55 | mry16679 | DEX0337_133 |
| DEX0337_56 | mry16737 | DEX0337_134 |
| DEX0337_57 | mry16788 | DEX0337_135 |
| DEX0337_58 | mry16796 | DEX0337_136 |
| DEX0337_59 | flex mry16796 | |
| DEX0337_60 | mry16808 | |
| DEX0337_61 | mry16823 | DEX0337_137 |
| DEX0337_62 | flex mry16823 | |
| DEX0337_63 | mry16840 | |
| DEX0337_64 | mry16866 | DEX0337_138 |
| DEX0337_65 | mry16881 | DEX0337_139 |
| DEX0337_66 | mry16899 | DEX0337_140 |
| DEX0337_67 | mry16905 | |
| DEX0337_68 | mry16953 | |
| DEX0337_69 | mry16983 | DEX0337_141 |
| DEX0337_70 | mry16999 | DEX0337_142 |
| DEX0337_71 | mry17001 | DEX0337_143 |
| DEX0337_72 | mry17002 | DEX0337_144 |
| DEX0337_73 | flex mry17002 | DEX0337_145 |
| DEX0337_74 | mry17010 | |
| DEX0337_75 | mry26089 | |
| DEX0337_76 | mry26204 | |
| DEX0337_77 | mry26237 | |
| DEX0337_78 | mry26278 | |
| DEX0337_79 | mry26393 | |
| DEX0337_80 | mry26505 | |
| DEX0337_81 | mry26515 | |
| DEX0337_82 | mry26743 | |
| DEX0337_83 | mry26768 | |
| DEX0337_84 | mry26994 | |
| DEX0337_85 | mry27242 | |
| DEX0337_86 | mry27281 | |
| DEX0337_87 | mry27330 | |
| DEX0337_88 | mry27363 | |
| DEX0337_89 | mry27399 | |
| DEX0337_90 | mry27436 | |
| DEX0337_91 | mry27438 | |
| DEX0337_92 | mry27510 | |
| DEX0337_93 | mry27564 | |
| DEX0337_94 | mry27609 | |
| DEX0337_95 | mry27635 | |
| DEX0337_96 | mry27636 | |
| DEX0337_97 | mry27664 | |
| DEX0337_98 | mry27774 | |
| DEX0337_99 | mry27818 | |
| DEX0337_100 | mry28002 | |
| DEX0337_101 | mry28011 | |
| DEX0337_102 | mry31791 | |
| DEX0337_103 | flex mry31791 | |
| DEX0337_104 | mry33414 | |
| DEX0337_105 | mry33868 | |

The source of the parent sequences are as follows:

| DEX0337_X | Parent | Library |
|---|---|---|
| DEX0337_75 | 26089 | PSovr003 |
| DEX0337_75 | 26089 | PSovr007 |
| DEX0337_75 | 26089 | PSovr008 |
| DEX0337_75 | 26089 | PSovr009 |

-continued

| DEX0337_X | Parent | Library |
|---|---|---|
| DEX0337_75 | 26089 | PSovr011 |
| DEX0337_76 | 26204 | PSovr005 |
| DEX0337_77 | 26237 | PSovr003 |
| DEX0337_78 | 26278 | PSovr003 |
| DEX0337_79 | 26393 | PSovr005 |
| DEX0337_80 | 26505 | PSovr007 |
| DEX0337_81 | 26515 | PSovr007 |
| DEX0337_82 | 26743 | PSovr008 |
| DEX0337_83 | 26768 | PSovr008 |
| DEX0337_84 | 26994 | PSovr009 |
| DEX0337_85 | 27242 | PSovr010 |
| DEX0337_86 | 27281 | PSovr010 |
| DEX0337_87 | 27330 | PSovr010 |
| DEX0337_88 | 27363 | PSovr011 |
| DEX0337_89 | 27399 | PSovr011 |
| DEX0337_90 | 27436 | PSovr011 |
| DEX0337_91 | 27438 | PSovr011 |
| DEX0337_92 | 27510 | PSovr011 |
| DEX0337_93 | 27564 | PSovr011 |
| DEX0337_94 | 27609 | PSovr011 |
| DEX0337_95 | 27635 | PSovr012 |
| DEX0337_96 | 27636 | PSovr012 |
| DEX0337_97 | 27664 | PSovr012 |
| DEX0337_98 | 27774 | PSovr012 |
| DEX0337_99 | 27818 | PSovr012 |
| DEX0337_100 | 28002 | PSovr012 |
| DEX0337_101 | 28011 | PSovr012 |

The summary of samples for ovarian PCR Select cDNA subtraction are as follows:

| library ID | Tester-Tissue I.D. | Driver Tissue |
|---|---|---|
| PSovr003 | Three ovarian tumor samples 1071C papillary cystadenocarcinoma 1005O papillary serous and endometrioid carcinoma 1040O papillary serous adenocarcinoma | Six normal tissues: kidney, pancreas, spleen, small intestine, heart, colon. All samples from Clontech, except for colon. Colon tissue ID: 9703C126RA |
| PSovr005 | 7O7O-97 cancer matching sample Papillary serous carcinoma | 706O-97 NAT |
| PSovr007 | Three ovarian tumor samples (papillary serous carcinoma) 1071C papillary cystadenocarcinoma 1005O papillary serous and endometrioid carcinoma 1040O papillary serous adenocarcinoma | From Clontech: pool of five normal ovaries. |
| PS.OVR008 | 2370V Invasive papillary serous adenocarcinoma | S9822105 papillary serous carcinoma of low malignant potential (LMP) |
| PS.OVR009 | S9822105 papillary serous carcinoma of low malignant potential (LMP) | 2370V Invasive papillary serous adenocarcinoma |
| PS.OVR010 | VNM00329 mucinous cystadenocarcinoma | 14638A1C mucinous cystic neoplasm of Low Malignant Potential |
| PS.OVR011 | 14638A1C mucinous cystic neoplasm of Low Malignant Potential | VNM00329 mucinous cystadenocarcinoma |
| PS.OVR012 | Pool of three 1071C papillary cystadenocarcinoma 1040O papillary serous adenocarcinoma 2370V Invasive papillary serous adenocarcinoma | Other female cancers: breast, endometrium, cervix and uterus, breast: 9703B011d; uterus: 850U; endometrium: 9901A185; cervix: VNM0056001 |

Example 2

Gene Expression Analysis

Custom Microarray Experiment—Ovarian Cancer

The source of the parent sequences for microarray were as follows: Parent sequences DEX0337_5-DEX0337_27 were obtained from CLASP mining of the LifeSeq Gold sequence database. Parent sequences DEX0337_75-DEX0337_101 were obtained by the subtraction experiments previously described. Parent sequences DEX0337_1-DEX0337_4 and DEX0337_28-DEX0337_74 were obtained by sequence assembly using ESTs from both the subtractions assembled with sequences from Incyte's LifeSeq Gold database.

Custom oligonucleotide microarrays were provided by Agilent Technologies, Inc. (Palo Alto, Calif.). The microarrays were fabricated by Agilent using their technology for the in-situ synthesis of 60mer oligonucleotides (Hughes, et al. 2001, Nature Biotechnology 19:342-347). The 60mer microarray probes were designed by Agilent, from gene sequences provided by diaDexus, using Agilent proprietary algorithms. Whenever possible two differents 60mers were designed for each gene of interest.

All microarray experiments were two-color experiments and were preformed using Agilent-recommended protocols and reagents. Briefly, each microarray was hybridized with cRNAs synthesized from polyA+ RNA, isolated from cancer and normal tissues, labeled with fluorescent dyes Cyanine3 and Cyanine5 (NEN Life Science Products, Inc., Boston, Mass.) using a linear amplification method (Agilent). In each experiment the experimental sample was polyA+ RNA isolated from cancer tissue from a single individual and the reference sample was a pool of polyA+ RNA isolated from normal tissues of the same organ as the cancerous tissue (i.e. normal ovarian tissue in experiments with ovarian cancer samples). Tissue descriptions are listed in the following table. Hybridizations were carried out at 60° C., overnight using Agilent in-situ hybridization buffer. Following washing, arrays were scanned with a GenePix 4000B Microarray Scanner (Axon Instruments, Inc., Union City, Calif.). The resulting images were analyzed with GenePix Pro 3.0 Microarray Acquisition and Analysis Software (Axon). Two different chip designs were evaluated with overlapping sets of a total of 19 samples, comparing the expression patterns of ovarian cancer derived polyA+ RNA to polyA+ RNA isolated from a pool of 9 normal ovarian tissues were analyzed. For Chip2 all 19 samples (14 invasive carcinomas (INV), 5 low malignant potential (LMP) samples) were analyzed and for Chip1 a subset of 17 of these samples (13 invasive carcinomas, 4 low malignant potential samples) were assessed.

Data normalization and expression profiling were done with Expressionist software from GeneData Inc. (Daly City, Calif./Basel, Switzerland). Gene expression analysis was performed using only experiments that meet certain quality criteria. The quality criteria that experiments must meet are a combination of evaluations performed by the Expressionist software and evaluations performed manually using raw and normalized data. To evaluate raw data quality, detection limits (the mean signal for a replicated negative control+2 Standard Deviations (SD)) for each channel were calculated. The detection limit is a measure of non-specific hybridization. Arrays with poor detection limits were not analyzed and the experiments were repeated. To evaluate normalized data quality, positive control elements included in the array were utilized. These array features should have a mean ratio of 1 (no differential expression). If these features have a mean ratio of greater than 1.5-fold up or down, the experiments were not analyzed further and were repeated. In addition to traditional scatter plots demonstrating the distribution of signal in each experiment, the Expressionist software also has minimum thresholding criteria that employ user defined parameters to identify quality data. Only those features that meet the threshold criteria were included in the filtering and analyses carried out by Expressionist. The thresholding settings employed require a minimum area percentage of 60% [(% pixels>background+2SD)−(% pixels saturated)], and a minimum signal to noise ratio of 2.0 in both channels. By these criteria, very low expressors and saturated features were not included in analysis.

Relative expression data was collected from Expressionist based on filtering and clustering analyses. Up- and down-regulated genes were identified using criteria for percentage of valid values obtained, and the percentage of experiments in which the gene is up- or down-regulated. These criteria were set independently for each data set, depending on the size and the nature of the data set. The results for the statistically significant upregulated and downregulated genes are shown in Table 1 and Table 2. The first three columns of each table contain information about the sequence itself (Oligo ID, Parent ID, and Patent#), the next 3 columns show the results obtained. '% valid' indicates the percentage of unique experiments total (n=17 for Chip1, n=19 for Chip2) in which a valid expression value was obtained, '% up' indicates the percentage of experiments in which up-regulation of at least 2-fold was observed, and '% down' indicates the percentage of the experiments in which down-regulation of at least 2-fold was observed. The last column in each table describes the location of the microarray probe (oligo) relative to the parent sequence. For genes that the parent sequence was extended using databases of public and proprietary sequences, the both the parent DEX number and the extended (FLEXS) DEX number are listed in the DEX ID column. In these cases, the site of the 60mer probe is listed in the last column.

TABLE 1

Sensitivity data for up-regulated genes.

| DEX ID | Parent ID | OligoID | "% valid, n = 17 *n = 19" | "% up, n = 17, *n = 19" | "% up INV, n = 13, *n = 14" | "% up LMP, n = 4, *n = 5" | Start Pos. Par. Seq | Stop Pos. Par. Seq | Start Pos. FLEXS | Stop Pos. FLEXS |
|---|---|---|---|---|---|---|---|---|---|---|
| DEX0337_3 DEX0337_4 | 4157 | 5236 | 100* | 31.6* | 42.9* | 0* | 930 | 989 | 929 | 988 |
| DEX0337_5 DEX0337_6 | 15155 | 26294.01 | 100 | 41.2 | 46.2 | 25 | 1056 | 1115 | 1049 | 1108 |
| DEX0337_5 DEX0337_6 | 15155 | 26294.02 | 94.1 | 35.3 | 38.5 | 25 | 1056 | 1115 | 1049 | 1108 |

TABLE 1-continued

Sensitivity data for up-regulated genes.

| DEX ID | Parent ID | OligoID | "% valid, n = 17 *n = 19" | "% up, n = 17, *n = 19" | "% up INV, n = 13, *n = 14" | "% up LMP, n = 4, *n = 5" | Start Pos. Par. Seq | Stop Pos. Par. Seq | Start Pos. FLEXS | Stop Pos. FLEXS |
|---|---|---|---|---|---|---|---|---|---|---|
| DEX0337_8 | 15272 | 32650.01 | 94.1 | 41.2 | 46.2 | 25 | 406 | 465 | | |
| DEX0337_8 | 15272 | 32650.02 | 94.1 | 47.1 | 53.8 | 25 | 406 | 465 | | |
| DEX0337_13 DEX0337_14 | 15405 | 13911.01 | 100 | 23.5 | 30.8 | 0 | 203 | 262 | 70 | 11 |
| DEX0337_13 DEX0337_14 | 15405 | 13911.02 | 88.2 | 29.4 | 30.8 | 25 | 203 | 262 | 70 | 11 |
| DEX0337_16 | 15467 | 15613.01 | 100 | 35.3 | 46.2 | 0 | 516 | 575 | | |
| DEX0337_16 | 15467 | 15613.02 | 94.1 | 41.2 | 53.8 | 0 | 516 | 575 | | |
| DEX0337_22 DEX0337_23 | 15630 | 17604.01 | 52.9 | 23.5 | 30.8 | 0 | 885 | 944 | 947 | 1006 |
| DEX0337_22 DEX0337_23 | 15630 | 17604.02 | 41.2 | 35.3 | 38.5 | 25 | 885 | 944 | 947 | 1006 |
| DEX0337_24 DEX0337_25 | 15658 | 10312.01 | 88.2 | 29.4 | 38.5 | 0 | 505 | 564 | 637 | 696 |
| DEX0337_24 DEX0337_25 | 15658 | 10312.02 | 88.2 | 29.4 | 30.8 | 25 | 505 | 564 | 637 | 696 |
| DEX0337_26 DEX0337_27 | 15673 | 26480.01 | 88.2 | 0 | 0 | 0 | 430 | 489 | 630 | 689 |
| DEX0337_26 DEX0337_27 | 15673 | 26480.02 | 82.4 | 23.5 | 30.8 | 0 | 430 | 489 | 630 | 689 |
| DEX0337_29 | 15781 | 14712.01 | 64.7 | 41.2 | 30.8 | 75 | 91 | 150 | | |
| DEX0337_29 | 15781 | 14712.02 | 70.6 | 47.1 | 30.8 | 100 | 91 | 150 | | |
| DEX0337_32 | 15867 | 16318.01 | 100 | 23.5 | 30.8 | 0 | 172 | 231 | | |
| DEX0337_32 | 15867 | 16318.02 | 100 | 23.5 | 30.8 | 0 | 172 | 231 | | |
| DEX0337_33 | 15874 | 16374.01 | 100 | 23.5 | 30.8 | 0 | 1793 | 1852 | | |
| DEX0337_33 | 15874 | 16374.02 | 100 | 17.6 | 23.1 | 0 | 1793 | 1852 | | |
| DEX0337_34 | 15985 | 17430.01 | 100 | 23.5 | 30.8 | 0 | 833 | 892 | | |
| DEX0337_34 | 15985 | 17430.02 | 100 | 17.6 | 23.1 | 0 | 833 | 892 | | |
| DEX0337_35 | 15996 | 17482.01 | 100 | 35.3 | 30.8 | 50 | 179 | 238 | | |
| DEX0337_35 | 15996 | 17482.02 | 100 | 41.2 | 38.5 | 50 | 179 | 238 | | |
| DEX0337_36 | 15998 | 17490.01 | 100 | 52.9 | 53.8 | 50 | 469 | 528 | | |
| DEX0337_36 | 15998 | 17490.02 | 100 | 58.8 | 53.8 | 75 | 469 | 528 | | |
| DEX0337_37 | 16007 | 18044.01 | 100 | 58.8 | 76.9 | 0 | 220 | 279 | | |
| DEX0337_37 | 16007 | 18044.02 | 100 | 64.7 | 84.6 | 0 | 220 | 279 | | |
| DEX0337_42 | 16281 | 20773.01 | 100 | 17.6 | 23.1 | 0 | 2181 | 2240 | | |
| DEX0337_42 | 16281 | 20773.02 | 94.1 | 23.5 | 30.8 | 0 | 2181 | 2240 | | |
| DEX0337_43 | 16285 | 20785.01 | 70.6 | 17.6 | 7.7 | 50 | 347 | 406 | | |
| DEX0337_43 | 16285 | 20785.02 | 82.4 | 17.6 | 7.7 | 50 | 347 | 406 | | |
| DEX0337_44 | 16315 | 21433.01 | 100 | 64.7 | 61.5 | 75 | 1550 | 1609 | | |
| DEX0337_44 | 16315 | 21433.02 | 100 | 64.7 | 61.5 | 75 | 1550 | 1609 | | |
| DEX0337_45 | 16528 | 23466.01 | 88.2 | 17.6 | 23.1 | 0 | 1621 | 1680 | | |
| DEX0337_45 | 16528 | 23466.02 | 100 | 23.5 | 30.8 | 0 | 1621 | 1680 | | |
| DEX0337_46 DEX0337_47 | 16562 | 23690.01 | 100 | 23.5 | 23.1 | 25 | 495 | 554 | 496 | 555 |
| DEX0337_46 DEX0337_47 | 16562 | 23690.02 | 100 | 29.4 | 30.8 | 25 | 495 | 554 | 496 | 555 |
| DEX0337_48 | 16608 | 24524.01 | 100 | 70.6 | 69.2 | 75 | 967 | 1026 | | |
| DEX0337_48 | 16608 | 24524.02 | 100 | 70.6 | 69.2 | 75 | 967 | 1026 | | |
| DEX0337_55 | 16679 | 25036.01 | 100 | 29.4 | 23.1 | 50 | 2243 | 2302 | | |
| DEX0337_55 | 16679 | 25036.02 | 100 | 29.4 | 23.1 | 50 | 2243 | 2302 | | |
| DEX0337_56 | 16737 | 9720.01 | 100 | 47.1 | 38.5 | 75 | 2070 | 2129 | | |
| DEX0337_56 | 16737 | 9720.02 | 100 | 52.9 | 46.2 | 75 | 2070 | 2129 | | |
| DEX0337_58 DEX0337_59 | 16796 | 9958.01 | 100 | 47.1 | 46.2 | 50 | 1339 | 1398 | 193 | 134 |
| DEX0337_58 DEX0337_59 | 16796 | 9958.02 | 100 | 47.1 | 46.2 | 50 | 1339 | 1398 | 193 | 134 |
| DEX0337_60 | 16808 | 10394.01 | 76.5 | 23.5 | 7.7 | 75 | 459 | 518 | | |
| DEX0337_60 | 16808 | 10394.02 | 82.4 | 23.5 | 7.7 | 75 | 459 | 518 | | |
| DEX0337_61 DEX0337_62 | 16823 | 10460.01 | 35.3 | 5.9 | 0 | 25 | 1800 | 1859 | 1801 | 1860 |
| DEX0337_61 DEX0337_62 | 16823 | 10460.02 | 88.2 | 23.5 | 15.4 | 50 | 1800 | 1859 | 1801 | 1860 |
| DEX0337_63 | 16840 | 10528.01 | 100 | 35.3 | 38.5 | 25 | 2731 | 2790 | | |
| DEX0337_63 | 16840 | 10528.02 | 100 | 35.3 | 38.5 | 25 | 2731 | 2790 | | |
| DEX0337_64 | 16866 | 10636.01 | 94.1 | 23.5 | 7.7 | 75 | 2655 | 2714 | | |
| DEX0337_64 | 16866 | 10636.02 | 88.2 | 23.5 | 7.7 | 75 | 2655 | 2714 | | |
| DEX0337_65 | 16881 | 10702.01 | 100 | 94.1 | 92.3 | 100 | 2409 | 2468 | | |
| DEX0337_65 | 16881 | 10702.02 | 100 | 94.1 | 92.3 | 100 | 2409 | 2468 | | |
| DEX0337_66 | 16899 | 10764.01 | 100 | 29.4 | 30.8 | 25 | 3450 | 3509 | | |
| DEX0337_66 | 16899 | 10764.02 | 100 | 23.5 | 30.8 | 0 | 3450 | 3509 | | |
| DEX0337_69 | 16983 | 11575.01 | 100 | 52.9 | 53.8 | 50 | 1687 | 1746 | | |
| DEX0337_69 | 16983 | 11575.02 | 100 | 52.9 | 53.8 | 50 | 1687 | 1746 | | |

TABLE 1-continued

Sensitivity data for up-regulated genes.

| DEX ID | Parent ID | OligoID | "% valid, n = 17 *n = 19" | "% up, n = 17, *n = 19" | "% up INV, n = 13, *n = 14" | "% up LMP, n = 4, *n = 5" | Start Pos. Par. Seq | Stop Pos. Par. Seq | Start Pos. FLEXS | Stop Pos. FLEXS |
|---|---|---|---|---|---|---|---|---|---|---|
| DEX0337_74 | 17010# | 12167.01 | 94.1 | 29.4 | 38.5 | 0 | 103 | 162 | | |
| DEX0337_74 | 17010# | 12167.02 | 100 | 11.8 | 15.4 | 0 | 103 | 162 | | |
| DEX0337_75 | 26089 | 56828.01 | 100 | 64.7 | 69.2 | 50 | 543 | 602 | | |
| DEX0337_75 | 26089 | 56828.02 | 100 | 64.7 | 53.8 | 100 | 543 | 602 | | |
| DEX0337_77 | 26237 | 97624.01 | 70.6 | 35.3 | 38.5 | 25 | 32 | 91 | | |
| DEX0337_77 | 26237 | 97624.02 | 70.6 | 23.5 | 23.1 | 25 | 32 | 91 | | |
| DEX0337_82 | 26743# | 58509.01 | 94.1 | 29.4 | 30.8 | 25 | 222 | 281 | | |
| DEX0337_82 | 26743# | 58509.02 | 100 | 35.3 | 38.5 | 25 | 222 | 281 | | |
| DEX0337_84 | 26994 | 59208.01 | 100 | 17.6 | 15.4 | 25 | 990 | 1049 | | |
| DEX0337_84 | 26994 | 59208.02 | 100 | 17.6 | 7.7 | 50 | 990 | 1049 | | |
| DEX0337_85 | 27242 | 59985.01 | 100 | 35.3 | 46.2 | 0 | 557 | 616 | | |
| DEX0337_85 | 27242 | 59985.02 | 100 | 35.3 | 46.2 | 0 | 557 | 616 | | |
| DEX0337_89 | 27399 | 70536.01 | 100 | 11.8 | 7.7 | 25 | 370 | 429 | | |
| DEX0337_89 | 27399 | 70536.02 | 100 | 23.5 | 7.7 | 75 | 370 | 429 | | |
| DEX0337_92 | 27510 | 70956.01 | 100 | 23.5 | 7.7 | 75 | 836 | 895 | | |
| DEX0337_92 | 27510 | 70956.02 | 100 | 23.5 | 7.7 | 75 | 836 | 895 | | |
| DEX0337_95 | 27635 | 71412.01 | 100 | 17.6 | 7.7 | 50 | 935 | 994 | | |
| DEX0337_95 | 27635 | 71412.02 | 100 | 17.6 | 7.7 | 50 | 935 | 994 | | |
| DEX0337_96 | 27636# | 71416.01 | 100 | 5.9 | 7.7 | 0 | 867 | 926 | | |
| DEX0337_96 | 27636# | 71416.02 | 100 | 17.6 | 7.7 | 50 | 867 | 926 | | |
| DEX0337_98 | 27774 | 71900.01 | 70.6 | 41.2 | 46.2 | 25 | 466 | 525 | | |
| DEX0337_98 | 27774 | 71900.02 | 47.1 | 29.4 | 30.8 | 25 | 466 | 525 | | |
| DEX0337_99 | 27818# | 72043.01 | 94.1 | 29.4 | 30.8 | 25 | 945 | 1004 | | |
| DEX0337_99 | 27818# | 72043.02 | 82.4 | 11.8 | 7.7 | 25 | 945 | 1004 | | |
| DEX0337_102 DEX0337_103 | 31791 | 92877.01 | 52.9 | 23.5 | 30.8 | 0 | 445 | 504 | 443 | 502 |
| DEX0337_102 DEX0337_103 | 31791 | 92877.02 | 76.5 | 29.4 | 38.5 | 0 | 445 | 504 | 443 | 502 |
| DEX0337_104 | 33414 | 98977.01 | 76.5 | 29.4 | 38.5 | 0 | 569 | 628 | | |
| DEX0337_104 | 33414 | 98977.02 | 88.2 | 35.3 | 46.2 | 0 | 569 | 628 | | |
| DEX0337_105 DEX0337_106 | 33868 | 100639.01 | 52.9 | 23.5 | 30.8 | 0 | 465 | 524 | 465 | 524 |
| DEX0337_105 DEX0337_106 | 33868 | 100639.02 | 76.5 | 17.6 | 23.1 | 0 | 465 | 524 | 465 | 524 |

Data derived from lower PMT (550v) scans, all other data derived from standard (PMT 600v) scans. Under the original analysis at 600v scans, the data for these oligos did not reach the threshold for expression ratio.

TABLE 2

Sensitivity data for down-regulated genes.

| DEX ID | Parent ID | OligoID | "% valid, n = 17 *n = 19" | "% up, n = 17, *n = 19" | "% up INV, n = 13, *n = 14" | "% up LMP, n = 4, *n = 5" | Start Pos. Par. Seq | Stop Pos. Par. Seq | Start Pos. FLEXS | Stop Pos. FLEXS |
|---|---|---|---|---|---|---|---|---|---|---|
| DEX0337_1 | 2111 | 5022 | 100* | 31.6* | 35.7* | 20* | 84 | 143 | | |
| DEX0337_2 | 3521 | 2311 | 100* | 21.1* | 14.3* | 40* | 91 | 150 | | |
| DEX0337_7 | 15229 | 23094.01 | 88.2 | 41.2 | 46.2 | 25 | 505 | 564 | | |
| DEX0337_7 | 15229 | 23094.02 | 88.2 | 35.3 | 38.5 | 25 | 505 | 564 | | |
| DEX0337_9 DEX0337_10 | 15337 | 13065.01 | 76.5 | 29.4 | 30.8 | 25 | 640 | 699 | 223 | 164 |
| DEX0337_9 DEX0337_10 | 15337 | 13065.02 | 76.5 | 17.6 | 15.4 | 25 | 640 | 699 | 223 | 164 |
| DEX0337_11 DEX0337_12 | 15382 | 22211.01 | 100 | 47.1 | 38.5 | 75 | 1110 | 1169 | 141 | 82 |
| DEX0337_11 DEX0337_12 | 15382 | 22211.02 | 100 | 52.9 | 46.2 | 75 | 1110 | 1169 | 141 | 82 |
| DEX0337_15 | 15451 | 9282.01 | 94.1 | 29.4 | 30.8 | 25 | 764 | 823 | | |
| DEX0337_15 | 15451 | 9282.02 | 88.2 | 29.4 | 30.8 | 25 | 764 | 823 | | |
| DEX0337_17 | 15525 | 9420.01 | 70.6 | 17.6 | 7.7 | 50 | 784 | 843 | | |
| DEX0337_17 | 15525 | 9420.02 | 82.4 | 17.6 | 15.4 | 25 | 784 | 843 | | |
| DEX0337_18 | 15565 | 40563.01 | 94.1 | 47.1 | 53.8 | 25 | 166 | 225 | | |
| DEX0337_18 | 15565 | 40563.02 | 82.4 | 23.5 | 23.1 | 25 | 166 | 225 | | |
| DEX0337_19 | 15600 | 9364.01 | 94.1 | 29.4 | 23.1 | 50 | 390 | 449 | | |
| DEX0337_19 | 15600 | 9364.02 | 94.1 | 29.4 | 23.1 | 50 | 390 | 449 | | |
| DEX0337_20 | 15613 | 33308.01 | 82.4 | 23.5 | 30.8 | 0 | 24 | 83 | | |
| DEX0337_20 | 15613 | 33308.02 | 76.5 | 17.6 | 23.1 | 0 | 24 | 83 | | |
| DEX0337_21 | 15622 | 37055.01 | 94.1 | 35.3 | 30.8 | 50 | 280 | 339 | | |

TABLE 2-continued

Sensitivity data for down-regulated genes.

| DEX ID | Parent ID | OligoID | "% valid, n = 17 *n = 19" | "% up, n = 17, *n = 19" | "% up INV, n = 13, *n = 14" | "% up LMP, n = 4, *n = 5" | Start Pos. Par. Seq | Stop Pos. Par. Seq | Start Pos. FLEXS | Stop Pos. FLEXS |
|---|---|---|---|---|---|---|---|---|---|---|
| DEX0337_21 | 15622 | 37055.02 | 100 | 35.3 | 30.8 | 50 | 280 | 339 | | |
| DEX0337_28 | 15778 | 14694.01 | 100 | 94.1 | 92.3 | 100 | 364 | 423 | | |
| DEX0337_28 | 15778 | 14694.02 | 100 | 94.1 | 92.3 | 100 | 364 | 423 | | |
| DEX0337_30 | 15859 | 16267.01 | 100 | 52.9 | 46.2 | 75 | 428 | 487 | | |
| DEX0337_30 | 15859 | 16267.02 | 94.1 | 23.5 | 15.4 | 50 | 428 | 487 | | |
| DEX0337_38 | 16160 | 19484.01 | 100 | 29.4 | 30.8 | 25 | 547 | 606 | | |
| DEX0337_38 | 16160 | 19484.02 | 100 | 29.4 | 30.8 | 25 | 547 | 606 | | |
| DEX0337_39 DEX0337_40 | 16164 | 19522.01 | 58.8 | 29.4 | 23.1 | 50 | 276 | 335 | 1079 | 1137 |
| DEX0337_39 DEX0337_40 | 16164 | 19522.02 | 100 | 64.7 | 53.8 | 100 | 276 | 335 | 1079 | 1137 |
| DEX0337_41 | 16208 | 20317.01 | 100 | 29.4 | 30.8 | 25 | 317 | 376 | | |
| DEX0337_41 | 16208 | 20317.02 | 100 | 29.4 | 30.8 | 25 | 317 | 376 | | |
| DEX0337_49 DEX0337_50 | 16623 | 24670.01 | 88.2 | 23.5 | 30.8 | 0 | 586 | 645 | 145 | 86 |
| DEX0337_49 DEX0337_50 | 16623 | 24670.02 | 94.1 | 29.4 | 30.8 | 25 | 586 | 645 | 145 | 86 |
| DEX0337_51 | 16637 | 24778.01 | 100 | 23.5 | 30.8 | 0 | 349 | 408 | | |
| DEX0337_51 | 16637 | 24778.02 | 94.1 | 11.8 | 15.4 | 0 | 349 | 408 | | |
| DEX0337_52 | 16662 | 24972.01 | 100 | 47.1 | 46.2 | 50 | 1960 | 2019 | | |
| DEX0337_52 | 16662 | 24972.02 | 100 | 41.2 | 46.2 | 25 | 1960 | 2019 | | |
| DEX0337_53 DEX0337_54 | 16664 | 24982.01 | 100 | 35.3 | 38.5 | 25 | 2863 | 2922 | 2861 | 2920 |
| DEX0337_53 DEX0337_54 | 16664 | 24982.02 | 100 | 47.1 | 53.8 | 25 | 2863 | 2922 | 2861 | 2920 |
| DEX0337_57 | 16788 | 9924.01 | 76.5 | 23.5 | 15.4 | 50 | 861 | 920 | | |
| DEX0337_57 | 16788 | 9924.02 | 64.7 | 17.6 | 23.1 | 0 | 861 | 920 | | |
| DEX0337_67 | 16905 | 11259.01 | 94.1 | 47.1 | 46.2 | 50 | 5362 | 5421 | | |
| DEX0337_67 | 16905 | 11259.02 | 88.2 | 29.4 | 30.8 | 25 | 5362 | 5421 | | |
| DEX0337_68 | 16953 | 11461.01 | 100 | 17.6 | 7.7 | 50 | 609 | 668 | | |
| DEX0337_68 | 16953 | 11461.02 | 100 | 17.6 | 7.7 | 50 | 609 | 668 | | |
| DEX0337_70 | 16999 | 11625.01 | 100 | 70.6 | 84.6 | 25 | 5360 | 5419 | | |
| DEX0337_70 | 16999 | 11625.02 | 100 | 70.6 | 84.6 | 25 | 5360 | 5419 | | |
| DEX0337_71 | 17001 | 12139.01 | 100 | 41.2 | 46.2 | 25 | 1917 | 1976 | | |
| DEX0337_71 | 17001 | 12139.02 | 100 | 41.2 | 46.2 | 25 | 1917 | 1976 | | |
| DEX0337_72 DEX0337_73 | 17002 | 12143.01 | 100 | 23.5 | 30.8 | 0 | 3910 | 3969 | 6228 | 6287 |
| DEX0337_72 DEX0337_73 | 17002 | 12143.02 | 100 | 17.6 | 23.1 | 0 | 3910 | 3969 | 6228 | 6287 |
| DEX0337_76 | 26204 | 57229.01 | 100 | 29.4 | 23.1 | 50 | 506 | 565 | | |
| DEX0337_76 | 26204 | 57229.02 | 94.1 | 23.5 | 15.4 | 50 | 506 | 565 | | |
| DEX0337_78 | 26278 | 57425.01 | 82.4 | 5.9 | 7.7 | 0 | 730 | 789 | | |
| DEX0337_78 | 26278 | 57425.02 | 100 | 17.6 | 7.7 | 50 | 730 | 789 | | |
| DEX0337_79 | 26393 | 57681.01 | 100 | 17.6 | 15.4 | 25 | 724 | 783 | | |
| DEX0337_79 | 26393 | 57681.02 | 100 | 17.6 | 7.7 | 50 | 724 | 783 | | |
| DEX0337_80 | 26505 | 57829.01 | 100 | 17.6 | 15.4 | 25 | 213 | 272 | | |
| DEX0337_80 | 26505 | 57829.02 | 100 | 23.5 | 15.4 | 50 | 213 | 272 | | |
| DEX0337_81 | 26515 | 57857.01 | 100 | 23.5 | 15.4 | 50 | 510 | 569 | | |
| DEX0337_81 | 26515 | 57857.02 | 94.1 | 11.8 | 7.7 | 25 | 510 | 569 | | |
| DEX0337_83 | 26768 | 58557.01 | 100 | 23.5 | 23.1 | 25 | 319 | 378 | | |
| DEX0337_83 | 26768 | 58557.02 | 100 | 23.5 | 15.4 | 50 | 319 | 378 | | |
| DEX0337_86 | 27281 | 70124.01 | 100 | 29.4 | 23.1 | 50 | 1169 | 1228 | | |
| DEX0337_86 | 27281 | 70124.02 | 88.2 | 11.8 | 7.7 | 25 | 1169 | 1228 | | |
| DEX0337_87 | 27330 | 70292.01 | 100 | 58.8 | 53.8 | 75 | 447 | 506 | | |
| DEX0337_87 | 27330 | 70292.02 | 100 | 58.8 | 53.8 | 75 | 447 | 506 | | |
| DEX0337_88 | 27363 | 70408.01 | 94.1 | 5.9 | 0 | 25 | 833 | 892 | | |
| DEX0337_88 | 27363 | 70408.02 | 94.1 | 11.8 | 0 | 50 | 833 | 892 | | |

TABLE 3

Microarray Tissue Descriptions

| Samples | Tissue ID | | age of patient | description of tumor | grade | stage |
|---|---|---|---|---|---|---|
| OV.L.MU.478A1B | 17478A1B | LMP | 33 | benign mucinous cystadenoma with focal proliferation | n/a | no |
| OV.I.SE370V | 2370V | INV | 47 | invasive papillary serous adenocarcinoma | 1-2 | IV |

TABLE 3-continued

Microarray Tissue Descriptions

| Samples | Tissue ID | | age of patient | description of tumor | grade | stage |
|---|---|---|---|---|---|---|
| OV.L1.SE105 | S9822105 | LMP | 29 | papillary serous carcinoma LMP | 0 | IC |
| OV.L.SE604A2B | 14604A2B | LMP | 64 | serous cystadenofibroma of low malignant potential(Patient w/transitional cell carcinoma, in-situ and invasive of the bladder grade III/III) | n/a | no |
| OV.I.EN360 | 9410C360 | INV | 52 | Endometrioid Adenocarcinoma, Stage Tx, Grade I/III | 1-3 | IV |
| OV.I.SE/EN005O | 1005O | INV | 60 | Papillary serous and endometrioid ovarian carcinoma. Metastatic breast cancer, probable ovarian cancer | 3 | IV |
| OV.INV.SE.1040O | 1040O | INV | 67 | papillary serous adenocarcinoma (Stage IV) | 2 | IV |
| OV.INV.SE.1071C | 1071C | INV | 51 | papilary cystadenocarcinoma (Stage IV) | 2 | IV |
| OV.INV.MU.009 | 9507H009 | INV | 87 | mucinous cystadenoma, multiloculated | N/A | |
| OV.LMP.MU.084 | 9808A084 | LMP | 47 | mucinous borderline (LMP) | GB | |
| OV.INV.SE.291D01 | VNM00291D01 | INV | 28 | serous cystadenocarcinoma (Stage II) | 1 | II |
| OV.I.MU329D01 | VNM00329D01 | INV | 40 | mucinous cystadenocarcinoma | 3 | n/a |
| OV.INV.MX.010SP1 | 9803G010SP1 | INV | 71 | poorly diff. clear cell, endometrioid & serous papillary types (Stage IV) | 4 | III |
| OV.I.EN/MU.608A | 95017608A | INV | 56 | endometrioid and mucinous adenocarcinoma | 2 | IV |
| OV.I.SE814V | 1814V | INV | 66 | Papillary serous adenocarcinoma, | 3-4 | IV |
| OV.L.MU638A1C | 14638A1C | LMP | 26 | mucinous cystic neoplasm of low malignant potential. | n/a | no |
| OV.I.SE/EN471A1B | 14471A1B | INV | 56 | poorly differentiated adenocarcinoma with serous and endometroid features | 3-4 | IV |
| OV.INV.SE.693C | S995693A | INV | 54 | serous papillary carcinoma (Stage IV) | N/A | |
| OV.INV.SE.116D04 | VNM00116D04 | INV | 47 | cystaadenocarcinoma | 1 | |

Example 3a

Alternative Splice Variants

We identified gene transcripts associated with cancer disease, development, or progression using cloning experiments, the Gencarta™ tools software (Compugen Ltd., Tel Aviv, Israel), and a variety of public and proprietary databases. These splice variants are either novel sequences which differ from a previously defined sequence or new uses of known sequences. In general the previously defined sequence for a family is annotated as DEX0443_XXX.nt.1 and the novel variants are annotated as DEX0443_XXX.nt.2, DEX0443_XXX.nt.3, etc. The novel variant DNA sequences encode novel proteins which differ from a previously defined protein sequence. In relation to the nucleotide sequence naming convention, the previously defined amino acid sequence is annotated DEX0443-XXX.aa.1 and the novel variants annotated as DEX0443_XXX.aa.2, etc.

The mapping of the nucleic acid ("NT") SEQ ID NO; NT DEX ID; Parent NT ID, chromosomal location (if known); open reading frame (ORF) location; amino acid ("AA") SEQ ID NO, AA DEX ID, and Parent AA ID are shown in the table below.

| SEQ ID NO | NT DEX ID | Parent NT ID | Chromo Map | ORF Loc | SEQ ID NO | AA DEX ID | Parent AA ID |
|---|---|---|---|---|---|---|---|
| 1 | DEX0443_001.nt.1 | DEX0337_13, DEX0337_14 | 7p11.2 | — | 249 | DEX0443_001.aa.1 | DEX0337_113 |
| 2 | DEX0443_001.nt.2 | DEX0337_13, DEX0337_14 | 7p11.2 | | | | |
| 3 | DEX0443_002.nt.1 | DEX0337_11, DEX0337_12 | 2q13 | — | 250 | DEX0443_002.aa.1 | DEX0337_112 |
| 4 | DEX0443_002.nt.2 | DEX0337_11, DEX0337_12 | 2q13 | | | | |
| 5 | DEX0443_002.nt.3 | DEX0337_11, DEX0337_12 | 2q13 | 274-601 | 251 | DEX0443_002.aa.3 | |
| 6 | DEX0443_003.nt.1 | DEX0337_35, DEX0337_36 | * | — | 252 | DEX0443_003.aa.1 | DEX0337_119 |
| 7 | DEX0443_003.nt.2 | DEX0337_35, DEX0337_36 | * | — | 253 | DEX0443_003.aa.2 | DEX0337_120 |

-continued

| SEQ ID NO | NT DEX ID | Parent NT ID | Chromo Map | ORF Loc | SEQ ID NO | AA DEX ID | Parent AA ID |
|---|---|---|---|---|---|---|---|
| 8 | DEX0443_004.nt.1 | DEX0337_34, DEX0337_45 | 9p24.3 | — | 254 | DEX0443_004.aa.1 | DEX0337_118 |
| 9 | DEX0443_004.nt.2 | DEX0337_34, DEX0337_45 | 9p24.3 | | | | |
| 10 | DEX0443_004.nt.3 | DEX0337_34, DEX0337_45 | 9p24.3 | 2985-5847 | 255 | DEX0443_004.aa.3 | |
| 11 | DEX0443_004.nt.4 | DEX0337_34, DEX0337_45 | 9p24.3 | 2962-5149 | 256 | DEX0443_004.aa.4 | |
| 12 | DEX0443_005.nt.1 | DEX0337_60 | 2q24.3 | | | | |
| 13 | DEX0443_006.nt.1 | DEX0337_58, DEX0337_59 | * | — | 257 | DEX0443_006.aa.1 | DEX0337_136 |
| 14 | DEX0443_006.nt.2 | DEX0337_58, DEX0337_59 | * | | | | |
| 15 | DEX0443_006.nt.3 | DEX0337_58, DEX0337_59 | * | 295-514 | 258 | DEX0443_006.aa.3 | |
| 16 | DEX0443_006.nt.4 | DEX0337_58, DEX0337_59 | * | 1-360 | 259 | DEX0443_006.aa.4 | |
| 17 | DEX0443_006.nt.5 | DEX0337_58, DEX0337_59 | * | 265-649 | 260 | DEX0443_006.aa.5 | |
| 18 | DEX0443_006.nt.6 | DEX0337_58, DEX0337_59 | * | 1-393 | 261 | DEX0443_006.aa.6 | |
| 19 | DEX0443_007.nt.1 | DEX0337_7 | 4q28.1 | — | 262 | DEX0443_007.aa.1 | DEX0337_110 |
| 20 | DEX0443_007.nt.2 | DEX0337_7 | 4q28.1 | 1-584 | 263 | DEX0443_007.aa.2 | |
| 21 | DEX0443_008.nt.1 | DEX0337_32 | 17p13.2 | — | 264 | DEX0443_008.aa.1 | DEX0337_116 |
| 22 | DEX0443_009.nt.1 | DEX0337_65 | 4q22.1 | — | 265 | DEX0443_009.aa.1 | DEX0337_139 |
| 23 | DEX0443_010.nt.1 | DEX0337_53, DEX0337_54 | 1p36.11 | — | 266 | DEX0443_010.aa.1 | DEX0337_132 |
| 24 | DEX0443_010.nt.2 | DEX0337_53, DEX0337_54 | 1p36.11 | | | | |
| 25 | DEX0443_011.nt.1 | DEX0337_69 | 9q34.3 | — | 267 | DEX0443_011.aa.1 | DEX0337_141 |
| 26 | DEX0443_011.nt.2 | DEX0337_69 | 9q34.3 | 1-790 | 268 | DEX0443_011.aa.2 | |
| 27 | DEX0443_011.nt.3 | DEX0337_69 | 9q34.3 | 1-1354 | 269 | DEX0443_011.aa.3 | |
| 28 | DEX0443_011.nt.4 | DEX0337_69 | 9q34.3 | 1-1345 | 270 | DEX0443_011.aa.4 | |
| 29 | DEX0443_011.nt.5 | DEX0337_69 | 9q34.3 | 2-410 | 271 | DEX0443_011.aa.5 | |
| 30 | DEX0443_011.nt.6 | DEX0337_69 | 9q34.3 | 1-455 | 272 | DEX0443_011.aa.6 | |
| 31 | DEX0443_011.nt.7 | DEX0337_69 | 9q34.3 | 1-685 | 273 | DEX0443_011.aa.7 | |
| 32 | DEX0443_012.nt.1 | DEX0337_65 | 4q22.1 | — | 265 | DEX0443_009.aa.1 | DEX0337_139 |
| 33 | DEX0443_012.nt.2 | DEX0337_65 | 4q22.1 | 1-371 | 274 | DEX0443_012.aa.2 | |
| 34 | DEX0443_013.nt.1 | DEX0337_8 | 12p13.2 | | | | |
| 35 | DEX0443_013.nt.2 | DEX0337_8 | 12p13.2 | — | | | |
| 36 | DEX0443_014.nt.1 | DEX0337_33 | 7q11.21 | — | 275 | DEX0443_014.aa.1 | DEX0337_117 |
| 37 | DEX0443_014.nt.2 | DEX0337_33 | 7q11.21 | 608-959 | 276 | DEX0443_014.aa.2 | |
| 38 | DEX0443_014.nt.3 | DEX0337_33 | 7q11.21 | 455-629 | 277 | DEX0443_014.aa.3 | |
| 39 | DEX0443_014.nt.4 | DEX0337_33 | 7q11.21 | 1025-1460 | 278 | DEX0443_014.aa.4 | |
| 40 | DEX0443_015.nt.1 | DEX0337_22, DEX0337_23 | 11p15.2 | | | | |
| 41 | DEX0443_015.nt.2 | DEX0337_22, DEX0337_23 | 11p15.2 | | | | |
| 42 | DEX0443_015.nt.3 | DEX0337_22, DEX0337_23 | 11p15.2 | 1-319 | 279 | DEX0443_015.aa.3 | |
| 43 | DEX0443_016.nt.1 | DEX0337_71 | 1p21.3 | — | 280 | DEX0443_016.aa.1 | DEX0337_143 |
| 44 | DEX0443_016.nt.2 | DEX0337_71 | 1p21.3 | 215-419 | 281 | DEX0443_016.aa.2 | |
| 45 | DEX0443_016.nt.3 | DEX0337_71 | 1p21.3 | 658-889 | 282 | DEX0443_016.aa.3 | |
| 46 | DEX0443_017.nt.1 | DEX0337_18 | 21q21.1 | | | | |
| 47 | DEX0443_018.nt.1 | DEX0337_20 | 3p14.1 | | | | |
| 48 | DEX0443_019.nt.1 | DEX0337_21 | 6p22.3 | | | | |
| 49 | DEX0443_020.nt.1 | DEX0337_61, DEX0337_62 | * | — | 283 | DEX0443_020.aa.1 | DEX0337_137 |
| 50 | DEX0443_020.nt.2 | DEX0337_61, DEX0337_62 | * | | | | |
| 51 | DEX0443_020.nt.3 | DEX0337_61, DEX0337_62 | * | 243-633 | 284 | DEX0443_020.aa.3 | |
| 52 | DEX0443_020.nt.4 | DEX0337_61, DEX0337_62 | * | 243-633 | 284 | DEX0443_020.aa.3 | |
| 53 | DEX0443_021.nt.1 | DEX0337_49, DEX0337_50 | 2q32.2 | — | 285 | DEX0443_021.aa.1 | DEX0337_131 |
| 54 | DEX0443_021.nt.2 | DEX0337_49, DEX0337_50 | 2q32.2 | | | | |
| 55 | DEX0443_021.nt.3 | DEX0337_49, DEX0337_50 | 2q32.2 | 609-1653 | 286 | DEX0443_021.aa.3 | |
| 56 | DEX0443_021.nt.4 | DEX0337_49, DEX0337_50 | 2q32.2 | 1212-2256 | 286 | DEX0443_021.aa.3 | |
| 57 | DEX0443_021.nt.5 | DEX0337_49, DEX0337_50 | 2q32.2 | 512-1496 | 287 | DEX0443_021.aa.5 | |
| 58 | DEX0443_021.nt.6 | DEX0337_49, DEX0337_50 | 2q32.2 | Jan-10 | 288 | DEX0443_021.aa.6 | |

-continued

| SEQ ID NO | NT DEX ID | Parent NT ID | Chromo Map | ORF Loc | SEQ ID NO | AA DEX ID | Parent AA ID |
|---|---|---|---|---|---|---|---|
| 59 | DEX0443_022.nt.1 | DEX0337_44 | 1p36.11 | | | | |
| 60 | DEX0443_022.nt.2 | DEX0337_44 | 1p36.11 | 1-250 | 289 | DEX0443_022.aa.2 | |
| 61 | DEX0443_022.nt.3 | DEX0337_44 | 1p36.11 | 189-1272 | 290 | DEX0443_022.aa.3 | |
| 62 | DEX0443_022.nt.4 | DEX0337_44 | 1p36.11 | 189-1590 | 291 | DEX0443_022.aa.4 | |
| 63 | DEX0443_022.nt.5 | DEX0337_44 | 1p36.11 | 189-1176 | 292 | DEX0443_022.aa.5 | |
| 64 | DEX0443_022.nt.6 | DEX0337_44 | 1p36.11 | 84-318 | 293 | DEX0443_022.aa.6 | |
| 65 | DEX0443_023.nt.1 | DEX0337_56, DEX9000_058.nt.1, DEX9000_058.nt.2, DEX9000_058.nt.3 | 20p12.2 | — | 294 | DEX0443_023.aa.1 | DEX0337_134 |
| 66 | DEX0443_023.nt.2 | DEX0337_56, DEX9000_058.nt.1, DEX9000_058.nt.2, DEX9000_058.nt.3 | 20p12.2 | — | 295 | DEX0443_023.aa.2 | DEX9000_058.aa.1 |
| 67 | DEX0443_023.nt.3 | DEX0337_56, DEX9000_058.nt.1, DEX9000_058.nt.2, DEX9000_058.nt.3 | 20p12.2 | — | 296 | DEX0443_023.aa.3 | DEX9000_058.aa.2 |
| 68 | DEX0443_023.nt.4 | DEX0337_56, DEX9000_058.nt.1, DEX9000_058.nt.2, DEX9000_058.nt.3 | 20p12.2 | — | 297 | DEX0443_023.aa.4 | DEX9000_058.aa.4 |
| 69 | DEX0443_023.nt.6 | DEX0337_56, DEX9000_058.nt.1, DEX9000_058.nt.2, DEX9000_058.nt.3 | 20p12.2 | 604-1570 | 298 | DEX0443_023.aa.6 | |
| 70 | DEX0443_023.nt.7 | DEX0337_56, DEX9000_058.nt.1, DEX9000_058.nt.2, DEX9000_058.nt.3 | 20p12.2 | 1-1123 | 299 | DEX0443_023.aa.7 | |
| 71 | DEX0443_024.nt.1 | DEX0337_17 | 7p14.2 | | | | |
| 72 | DEX0443_025.nt.1 | DEX0337_64 | * | — | 300 | DEX0443_025.aa.1 | DEX0337_138 |
| 73 | DEX0443_026.nt.1 | DEX0337_63 | 1q32.3 | | | | |
| 74 | DEX0443_026.nt.2 | DEX0337_63 | 1q32.3 | — | | | |
| 75 | DEX0443_026.nt.3 | DEX0337_63 | 1q32.3 | 512-1361 | 301 | DEX0443_026.aa.3 | |
| 76 | DEX0443_027.nt.1 | DEX0337_37 | 2p25.1 | — | 302 | DEX0443_027.aa.1 | DEX0337_121 |
| 77 | DEX0443_028.nt.1 | DEX0337_30, DEX0337_31 | 11q13.3 | — | 303 | DEX0443_028.aa.1 | DEX0337_115 |
| 78 | DEX0443_028.nt.2 | DEX0337_30, DEX0337_31 | 11q13.3 | | | | |
| 79 | DEX0443_028.nt.3 | DEX0337_30, DEX0337_31 | 11q13.3 | 1172-1631 | 304 | DEX0443_028.aa.3 | |
| 80 | DEX0443_028.nt.4 | DEX0337_30, DEX0337_31 | 11q13.3 | 1046-1505 | 304 | DEX0443_028.aa.3 | |
| 81 | DEX0443_029.nt.1 | DEX0337_16 | 3q22.1 | | | | |
| 82 | DEX0443_029.nt.2 | DEX0337_16 | 3q22.1 | — | | | |
| 83 | DEX0443_030.nt.1 | DEX0337_39, DEX0337_40 | 12p12.3 | — | 305 | DEX0443_030.aa.1 | DEX0337_123 |
| 84 | DEX0443_030.nt.2 | DEX0337_39, DEX0337_40 | 12p12.3 | — | 306 | DEX0443_030.aa.2 | DEX0337_124 |
| 85 | DEX0443_030.nt.3 | DEX0337_39, DEX0337_40 | 12p12.3 | 1-441 | 307 | DEX0443_030.aa.3 | |
| 86 | DEX0443_030.nt.4 | DEX0337_39, DEX0337_40 | 12p12.3 | 1-564 | 308 | DEX0443_030.aa.4 | |
| 87 | DEX0443_030.nt.5 | DEX0337_39, DEX0337_40 | 12p12.3 | 1-349 | 309 | DEX0443_030.aa.5 | |
| 88 | DEX0443_030.nt.6 | DEX0337_39, DEX0337_40 | 12p12.3 | 1-450 | 310 | DEX0443_030.aa.6 | |
| 89 | DEX0443_030.nt.7 | DEX0337_39, DEX0337_40 | 12p12.3 | 1-261 | 311 | DEX0443_030.aa.7 | |
| 90 | DEX0443_030.nt.8 | DEX0337_39, DEX0337_40 | 12p12.3 | 1-345 | 312 | DEX0443_030.aa.8 | |
| 91 | DEX0443_030.nt.9 | DEX0337_39, DEX0337_40 | 12p12.3 | 1-440 | 313 | DEX0443_030.aa.9 | |
| 92 | DEX0443_031.nt.1 | DEX0337_19 | 8q23.1 | | | | |
| 93 | DEX0443_032.nt.1 | DEX0337_37 | 2p25.1 | — | 302 | DEX0443_027.aa.1 | DEX0337_121 |
| 94 | DEX0443_032.nt.2 | DEX0337_37 | 2p25.1 | 1-1595 | 314 | DEX0443_032.aa.2 | |
| 95 | DEX0443_033.nt.1 | DEX0337_72, DEX0337_73 | 13q14.11 | — | 315 | DEX0443_033.aa.1 | DEX0337_144 |
| 96 | DEX0443_033.nt.2 | DEX0337_72, DEX0337_73 | 13q14.11 | — | 316 | DEX0443_033.aa.2 | DEX0337_145 |
| 97 | DEX0443_033.nt.3 | DEX0337_72, DEX0337_73 | 13q14.11 | 1-495 | 317 | DEX0443_033.aa.3 | |
| 98 | DEX0443_034.nt.1 | DEX0337_52 | 17q21.33 | | | | |
| 99 | DEX0443_034.nt.2 | DEX0337_52 | 17q21.33 | 197-1281 | 318 | DEX0443_034.aa.2 | |
| 100 | DEX0443_035.nt.1 | DEX0337_66 | 1q25.3 | — | 319 | DEX0443_035.aa.1 | DEX0337_140 |

-continued

| SEQ ID NO | NT DEX ID | Parent NT ID | Chromo Map | ORF Loc | SEQ ID NO | AA DEX ID | Parent AA ID |
|---|---|---|---|---|---|---|---|
| 101 | DEX0443_036.nt.1 | DEX0337_5, DEX0337_6 | 6q27 | — | 320 | DEX0443_036.aa.1 | DEX0337_109 |
| 102 | DEX0443_036.nt.2 | DEX0337_5, DEX0337_6 | 6q27 | | | | |
| 103 | DEX0443_036.nt.3 | DEX0337_5, DEX0337_6 | 6q27 | — | | | |
| 104 | DEX0443_037.nt.1 | DEX0337_41 | 19p13.12 | — | 321 | DEX0443_037.aa.1 | DEX0337_125 |
| 105 | DEX0443_037.nt.2 | DEX0337_41 | 19p13.12 | 108-645 | 322 | DEX0443_037.aa.2 | |
| 106 | DEX0443_037.nt.3 | DEX0337_41 | 19p13.12 | 108-675 | 323 | DEX0443_037.aa.3 | |
| 107 | DEX0443_037.nt.4 | DEX0337_41 | 19p13.12 | 1-327 | 324 | DEX0443_037.aa.4 | |
| 108 | DEX0443_038.nt.1 | DEX0337_98 | * | | | | |
| 109 | DEX0443_039.nt.1 | DEX0337_68 | 6p21.31 | | | | |
| 110 | DEX0443_039.nt.2 | DEX0337_68 | 6p21.31 | 1-753 | 325 | DEX0443_039.aa.2 | |
| 111 | DEX0443_039.nt.3 | DEX0337_68 | 6p21.31 | 1-207 | 326 | DEX0443_039.aa.3 | |
| 112 | DEX0443_039.nt.4 | DEX0337_68 | 6p21.31 | 1039-1705 | 327 | DEX0443_039.aa.4 | |
| 113 | DEX0443_039.nt.5 | DEX0337_68 | 6p21.31 | 1-753 | 325 | DEX0443_039.aa.2 | |
| 114 | DEX0443_040.nt.1 | DEX0337_51 | 8p12 | | | | |
| 115 | DEX0443_041.nt.1 | DEX0337_3, DEX0337_4 | 1q23.3 | | | | |
| 116 | DEX0443_041.nt.10 | DEX0337_3, DEX0337_4 | 1q23.3 | 599-926 | 328 | DEX0443_041.aa.8 | |
| 117 | DEX0443_041.nt.11 | DEX0337_3, DEX0337_4 | 1q23.3 | 1-520 | 329 | DEX0443_041.aa.11 | |
| 118 | DEX0443_041.nt.12 | DEX0337_3, DEX0337_4 | 1q23.3 | 497-1505 | 330 | DEX0443_041.aa.12 | |
| 119 | DEX0443_041.nt.13 | DEX0337_3, DEX0337_4 | 1q23.3 | 497-1553 | 331 | DEX0443_041.aa.13 | |
| 120 | DEX0443_041.nt.14 | DEX0337_3, DEX0337_4 | 1q23.3 | 1-753 | 332 | DEX0443_041.aa.14 | |
| 121 | DEX0443_041.nt.2 | DEX0337_3, DEX0337_4 | 1q23.3 | — | 333 | DEX0443_041.aa.2 | DEX0337_108 |
| 122 | DEX0443_041.nt.3 | DEX0337_3, DEX0337_4 | 1q23.3 | 1-342 | 334 | DEX0443_041.aa.3 | |
| 123 | DEX0443_041.nt.4 | DEX0337_3, DEX0337_4 | 1q23.3 | 1-664 | 335 | DEX0443_041.aa.4 | |
| 124 | DEX0443_041.nt.5 | DEX0337_3, DEX0337_4 | 1q23.3 | 1-601 | 336 | DEX0443_041.aa.5 | |
| 125 | DEX0443_041.nt.6 | DEX0337_3, DEX0337_4 | 1q23.3 | 2-320 | 337 | DEX0443_041.aa.6 | |
| 126 | DEX0443_041.nt.7 | DEX0337_3, DEX0337_4 | 1q23.3 | 454-850 | 338 | DEX0443_041.aa.7 | |
| 127 | DEX0443_041.nt.8 | DEX0337_3, DEX0337_4 | 1q23.3 | 599-926 | 328 | DEX0443_041.aa.8 | |
| 128 | DEX0443_041.nt.9 | DEX0337_3, DEX0337_4 | 1q23.3 | 998-1325 | 328 | DEX0443_041.aa.8 | |
| 129 | DEX0443_042.nt.1 | DEX0337_46, DEX0337_47 | 9p13.3 | — | 339 | DEX0443_042.aa.1 | DEX0337_128 |
| 130 | DEX0443_042.nt.2 | DEX0337_46, DEX0337_47 | 9p13.3 | — | 340 | DEX0443_042.aa.2 | DEX0337_129 |
| 131 | DEX0443_042.nt.3 | DEX0337_46, DEX0337_47 | 9p13.3 | 1-1106 | 341 | DEX0443_042.aa.3 | |
| 132 | DEX0443_042.nt.4 | DEX0337_46, DEX0337_47 | 9p13.3 | 1-645 | 342 | DEX0443_042.aa.4 | |
| 133 | DEX0443_043.nt.1 | DEX0337_48 | 4p16.3 | — | 343 | DEX0443_043.aa.1 | DEX0337_130 |
| 134 | DEX0443_044.nt.1 | DEX0337_55 | 2q37.3 | — | 344 | DEX0443_044.aa.1 | DEX0337_133 |
| 135 | DEX0443_044.nt.2 | DEX0337_55 | 2q37.3 | 1-1354 | 345 | DEX0443_044.aa.2 | |
| 136 | DEX0443_044.nt.3 | DEX0337_55 | 2q37.3 | 1-1101 | 346 | DEX0443_044.aa.3 | |
| 137 | DEX0443_044.nt.4 | DEX0337_55 | 2q37.3 | Jan-71 | 347 | DEX0443_044.aa.4 | |
| 138 | DEX0443_045.nt.1 | DEX0337_24, DEX0337_25 | 12q15 | — | 348 | DEX0443_045.aa.1 | DEX0337_114 |
| 139 | DEX0443_045.nt.2 | DEX0337_24, DEX0337_25 | 12q15 | | | | |
| 140 | DEX0443_046.nt.1 | DEX0337_64 | * | — | 300 | DEX0443_025.aa.1 | DEX0337_138 |
| 141 | DEX0443_046.nt.2 | DEX0337_64 | * | 6-702 | 349 | DEX0443_046.aa.2 | |
| 142 | DEX0443_047.nt.1 | DEX0337_10, DEX0337_9 | 4q27 | | | | |
| 143 | DEX0443_047.nt.2 | DEX0337_10, DEX0337_9 | 4q27 | — | 350 | DEX0443_047.aa.2 | DEX0337_111 |
| 144 | DEX0443_048.nt.1 | DEX0337_1 | 9q21.12 | | | | |
| 145 | DEX0443_049.nt.1 | DEX0337_42, DEX9000_052.nt.1, DEX9000_052.nt.2, DEX9000_052.nt.3 | 12p13.31 | — | 351 | DEX0443_049.aa.1 | DEX0337_126 |

-continued

| SEQ ID NO | NT DEX ID | Parent NT ID | Chromo Map | ORF Loc | SEQ ID NO | AA DEX ID | Parent AA ID |
|---|---|---|---|---|---|---|---|
| 146 | DEX0443_049.nt.2 | DEX0337_42, DEX9000_052.nt.1, DEX9000_052.nt.2, DEX9000_052.nt.3 | 12p13.31 | — | 352 | DEX0443_049.aa.2 | DEX9000_052.aa.1 |
| 147 | DEX0443_049.nt.3 | DEX0337_42, DEX9000_052.nt.1, DEX9000_052.nt.2, DEX9000_052.nt.3 | 12p13.31 | — | 353 | DEX0443_049.aa.3 | DEX9000_052.aa.2 |
| 148 | DEX0443_049.nt.4 | DEX0337_42, DEX9000_052.nt.1, DEX9000_052.nt.2, DEX9000_052.nt.3 | 12p13.31 | — | 354 | DEX0443_049.aa.4 | DEX9000_052.aa.3 |
| 149 | DEX0443_049.nt.5 | DEX0337_42, DEX9000_052.nt.1, DEX9000_052.nt.2, DEX9000_052.nt.3 | 12p13.31 | 248-2156 | 355 | DEX0443_049.aa.5 | |
| 150 | DEX0443_049.nt.6 | DEX0337_42, DEX9000_052.nt.1, DEX9000_052.nt.2, DEX9000_052.nt.3 | 12p13.31 | 1-585 | 356 | DEX0443_049.aa.6 | |
| 151 | DEX0443_049.nt.7 | DEX0337_42, DEX9000_052.nt.1, DEX9000_052.nt.2, DEX9000_052.nt.3 | 12p13.31 | 248-1166 | 357 | DEX0443_049.aa.7 | |
| 152 | DEX0443_050.nt.1 | DEX0337_28 | 1p13.3 | | | | |
| 153 | DEX0443_051.nt.1 | DEX0337_26, DEX0337_27 | 15q15.3 | | | | |
| 154 | DEX0443_051.nt.2 | DEX0337_26, DEX0337_27 | 15q15.3 | | | | |
| 155 | DEX0443_051.nt.3 | DEX0337_26, DEX0337_27 | 15q15.3 | 126-3510 | 358 | DEX0443_051.aa.3 | |
| 156 | DEX0443_051.nt.4 | DEX0337_26, DEX0337_27 | 15q15.3 | 1-169 | 359 | DEX0443_051.aa.4 | |
| 157 | DEX0443_051.nt.5 | DEX0337_26, DEX0337_27 | 15q15.3 | 1-221 | 360 | DEX0443_051.aa.5 | |
| 158 | DEX0443_052.nt.1 | DEX0337_66 | 1q25.3 | — | 319 | DEX0443_035.aa.1 | DEX0337_140 |
| 159 | DEX0443_053.nt.1 | DEX0337_6 | 6q27 | | | | |
| 160 | DEX0443_054.nt.1 | DEX0337_70 | 15q26.2 | — | 361 | DEX0443_054.aa.1 | DEX0337_142 |
| 161 | DEX0443_055.nt.1 | DEX0337_67 | 13q33.3 | | | | |
| 162 | DEX0443_055.nt.2 | DEX0337_67 | 13q33.3 | 245-1067 | 362 | DEX0443_055.aa.2 | |
| 163 | DEX0443_055.nt.3 | DEX0337_67 | 13q33.3 | 224-653 | 363 | DEX0443_055.aa.3 | |
| 164 | DEX0443_055.nt.4 | DEX0337_67 | 13q33.3 | 245-1067 | 362 | DEX0443_055.aa.2 | |
| 165 | DEX0443_055.nt.5 | DEX0337_67 | 13q33.3 | 245-1067 | 362 | DEX0443_055.aa.2 | |
| 166 | DEX0443_055.nt.6 | DEX0337_67 | 13q33.3 | 245-1067 | 362 | DEX0443_055.aa.2 | |
| 167 | DEX0443_056.nt.1 | DEX0337_77 | * | | | | |
| 168 | DEX0443_056.nt.2 | DEX0337_77 | * | — | | | |
| 169 | DEX0443_057.nt.1 | DEX0337_15 | 6p22.3 | | | | |
| 170 | DEX0443_057.nt.2 | DEX0337_15 | 6p22.3 | 178-487 | 364 | DEX0443_057.aa.2 | |
| 171 | DEX0443_057.nt.3 | DEX0337_15 | 6p22.3 | 1-279 | 365 | DEX0443_057.aa.3 | |
| 172 | DEX0443_057.nt.4 | DEX0337_15 | 6p22.3 | 178-661 | 366 | DEX0443_057.aa.4 | |
| 173 | DEX0443_057.nt.5 | DEX0337_15 | 6p22.3 | 1-279 | 365 | DEX0443_057.aa.3 | |
| 174 | DEX0443_058.nt.1 | DEX0337_38 | 6p21.31 | — | 367 | DEX0443_058.aa.1 | DEX0337_122 |
| 175 | DEX0443_058.nt.2 | DEX0337_38 | 6p21.31 | 34-214 | 368 | DEX0443_058.aa.2 | |
| 176 | DEX0443_058.nt.3 | DEX0337_38 | 6p21.31 | 114-447 | 369 | DEX0443_058.aa.3 | |
| 177 | DEX0443_058.nt.4 | DEX0337_38 | 6p21.31 | 1-187 | 370 | DEX0443_058.aa.4 | |
| 178 | DEX0443_059.nt.1 | DEX0337_2 | 1q22 | | | | |
| 179 | DEX0443_059.nt.2 | DEX0337_2 | 1q22 | 151-1358 | 371 | DEX0443_059.aa.2 | |
| 180 | DEX0443_059.nt.3 | DEX0337_2 | 1q22 | 863-1595 | 372 | DEX0443_059.aa.3 | |
| 181 | DEX0443_059.nt.4 | DEX0337_2 | 1q22 | 863-1595 | 372 | DEX0443_059.aa.3 | |
| 182 | DEX0443_060.nt.1 | DEX0337_74 | 17q25.1 | | | | |
| 183 | DEX0443_060.nt.2 | DEX0337_74 | 17q25.1 | 474-1617 | 373 | DEX0443_060.aa.2 | |
| 184 | DEX0443_060.nt.3 | DEX0337_74 | 17q25.1 | 474-2514 | 374 | DEX0443_060.aa.3 | |
| 185 | DEX0443_060.nt.4 | DEX0337_74 | 17q25.1 | 474-1617 | 373 | DEX0443_060.aa.2 | |
| 186 | DEX0443_060.nt.5 | DEX0337_74 | 17q25.1 | 474-1617 | 373 | DEX0443_060.aa.2 | |
| 187 | DEX0443_060.nt.6 | DEX0337_74 | 17q25.1 | 176-548 | 375 | DEX0443_060.aa.6 | |
| 188 | DEX0443_060.nt.7 | DEX0337_74 | 17q25.1 | 1-289 | 376 | DEX0443_060.aa.7 | |
| 189 | DEX0443_061.nt.1 | DEX0337_43 | 9q22.32 | | | | |
| 190 | DEX0443_061.nt.2 | DEX0337_43 | 9q22.32 | 838-1043 | 377 | DEX0443_061.aa.2 | |
| 191 | DEX0443_062.nt.1 | DEX0337_57 | * | — | 378 | DEX0443_062.aa.1 | DEX0337_135 |
| 192 | DEX0443_062.nt.2 | DEX0337_57 | * | 1-212 | 379 | DEX0443_062.aa.2 | |
| 193 | DEX0443_063.nt.1 | DEX0337_82 | | | | | |
| 194 | DEX0443_064.nt.1 | DEX0337_71 | | — | 380 | DEX0443_064.aa.1 | DEX0337_143 |
| 195 | DEX0443_065.nt.1 | DEX0337_95 | | | | | |
| 196 | DEX0443_066.nt.1 | DEX0337_72 | | — | 381 | DEX0443_066.aa.1 | DEX0337_144 |
| 197 | DEX0443_066.nt.2 | DEX0337_73 | | — | 382 | DEX0443_066.aa.2 | DEX0337_145 |
| 198 | DEX0443_067.nt.1 | DEX0337_33 | | — | 383 | DEX0443_067.aa.1 | DEX0337_117 |

-continued

| SEQ ID NO | NT DEX ID | Parent NT ID | Chromo Map | ORF Loc | SEQ ID NO | AA DEX ID | Parent AA ID |
|---|---|---|---|---|---|---|---|
| 199 | DEX0443_068.nt.1 | DEX0337_96 | | | | | |
| 200 | DEX0443_069.nt.1 | DEX0337_93 | | | | | |
| 201 | DEX0443_070.nt.1 | DEX0337_99 | | | | | |
| 202 | DEX0443_071.nt.1 | DEX0337_57 | | — | 384 | DEX0443_071.aa.1 | DEX0337_135 |
| 203 | DEX0443_072.nt.1 | DEX0337_100 | | | | | |
| 204 | DEX0443_073.nt.1 | DEX0337_83 | | | | | |
| 205 | DEX0443_074.nt.1 | DEX0337_76 | | | | | |
| 206 | DEX0443_075.nt.1 | DEX0337_69 | | — | 385 | DEX0443_075.aa.1 | DEX0337_141 |
| 207 | DEX0443_076.nt.1 | DEX0337_7 | | — | 386 | DEX0443_076.aa.1 | DEX0337_110 |
| 208 | DEX0443_077.nt.1 | DEX0337_42 | | — | 387 | DEX0443_077.aa.1 | DEX0337_126 |
| 209 | DEX0443_078.nt.1 | DEX0337_87 | | | | | |
| 210 | DEX0443_079.nt.1 | DEX0337_85 | | | | | |
| 211 | DEX0443_080.nt.1 | DEX0337_92 | | | | | |
| 212 | DEX0443_081.nt.1 | DEX0337_48 | | — | 388 | DEX0443_081.aa.1 | DEX0337_130 |
| 213 | DEX0443_082.nt.1 | DEX0337_2 | | | | | |
| 214 | DEX0443_083.nt.1 | DEX0337_81 | | | | | |
| 215 | DEX0443_084.nt.1 | DEX0337_43 | | | | | |
| 216 | DEX0443_085.nt.1 | DEX0337_75 | | | | | |
| 217 | DEX0443_086.nt.1 | DEX0337_86 | | | | | |
| 218 | DEX0443_087.nt.1 | DEX0337_60 | | | | | |
| 219 | DEX0443_088.nt.1 | DEX0337_79 | | | | | |
| 220 | DEX0443_089.nt.1 | DEX0337_94 | | | | | |
| 221 | DEX0443_090.nt.1 | DEX0337_74 | | | | | |
| 222 | DEX0443_091.nt.1 | DEX0337_1 | | | | | |
| 223 | DEX0443_092.nt.1 | DEX0337_28 | | | | | |
| 224 | DEX0443_093.nt.1 | DEX0337_32 | | — | 389 | DEX0443_093.aa.1 | DEX0337_116 |
| 225 | DEX0443_094.nt.1 | DEX0337_65 | | — | 390 | DEX0443_094.aa.1 | DEX0337_139 |
| 226 | DEX0443_095.nt.1 | DEX0337_64 | | — | 391 | DEX0443_095.aa.1 | DEX0337_138 |
| 227 | DEX0443_096.nt.1 | DEX0337_97 | | | | | |
| 228 | DEX0443_097.nt.1 | DEX0337_58 | | — | 392 | DEX0443_097.aa.1 | DEX0337_136 |
| 229 | DEX0443_097.nt.2 | DEX0337_59 | | | | | |
| 230 | DEX0443_098.nt.1 | DEX0337_89 | | | | | |
| 231 | DEX0443_099.nt.1 | DEX0337_101 | | | | | |
| 232 | DEX0443_100.nt.1 | DEX0337_35 | | — | 393 | DEX0443_100.aa.1 | DEX0337_119 |
| 233 | DEX0443_101.nt.1 | DEX0337_98 | | | | | |
| 234 | DEX0443_102.nt.1 | DEX0337_40 | | — | 394 | DEX0443_102.aa.1 | DEX0337_124 |
| 235 | DEX0443_102.nt.2 | DEX0337_39 | | — | 395 | DEX0443_102.aa.2 | DEX0337_123 |
| 236 | DEX0443_103.nt.1 | DEX0337_84 | | | | | |
| 237 | DEX0443_104.nt.1 | DEX0337_77 | | | | | |
| 238 | DEX0443_105.nt.1 | DEX0337_80 | | | | | |
| 239 | DEX0443_106.nt.1 | DEX0337_45 | | | | | |
| 240 | DEX0443_107.nt.1 | DEX0337_18 | | | | | |
| 241 | DEX0443_108.nt.1 | DEX0337_27 | | | | | |
| 242 | DEX0443_109.nt.1 | DEX0337_24 | | — | 396 | DEX0443_109.aa.1 | DEX0337_114 |
| 243 | DEX0443_109.nt.2 | DEX0337_25 | | | | | |
| 244 | DEX0443_110.nt.1 | DEX0337_88 | | | | | |
| 245 | DEX0443_111.nt.1 | DEX0337_90 | | | | | |
| 246 | DEX0443_112.nt.1 | DEX0337_29 | | | | | |
| 247 | DEX0443_113.nt.1 | DEX0337_78 | | | | | |
| 248 | DEX0443_114.nt.1 | DEX0337_91 | | | | | |

EST Support

The alternative splice variants were predicted by computational analysis of Expressed Sequence Tags (ESTs) derived form public and proprietary cDNA libraries and genomic information.

SAGE Support

Serial Analysis of Gene Expression (SAGE) tag data analysis is preformed on the splice variants. Gencarta™ tools (Compugen Ltd., Tel Aviv, Israel) report SAGE tag data for individual transcripts when available. SAGE data includes the SAGE tag sequence for the transcript, expression level (as a ratio) of the SAGE tag in tissue samples, the source or tissue, state or disease condition of the tissue, tissue sample type, and a description of the tissue samples.

Sequence Alignment Support

Alignments of previously identified reference sequences and novel splice variant sequences are performed to confirm unique portions of splice variant nucleic acid and amino acid sequences. The alignments are done using the Needle program in the European Molecular Biology Open Software Suite (EMBOSS) version 2.2.0 available at emboss with the extension .org of the world wide web from EMBnet (embnet with the extension .org of the world wide web). Default settings are used unless otherwise noted. The Needle program in EMBOSS implements the Needleman-Wunsch algorithm. Needleman, S. B., Wunsch, C. D., *J. Mol. Biol.* 48:443-453 (1970).

It is well know to those skilled in the art that implication of alignment algorithms by various programs may result in minor changes in the generated output. These changes include but are not limited to: alignment scores (percent identity, similarity, and gap), display of nonaligned flanking sequence regions, and number assignment to residues. These minor changes in the output of an alignment do not alter the physical characteristics of the sequences or the differences between the sequences, e.g. regions of homology, insertions, or deletions. Descriptions of alignments are provided in each splice variant section below.

Splice Variant Polypeptide Annotation

The polypeptides of the present invention were analyzed and the following attributes were identified; specifically, epitopes, post translational modifications, signal peptides and transmembrane domains. Antigenicity (Epitope) prediction was performed through the antigenic module in the EMBOSS package. Rice, P., EMBOSS: The European Molecular Biology Open Software Suite, *Trends in Genetics* 16(6): 276-277 (2000). The antigenic module predicts potentially antigenic regions of a protein sequence, using the method of Kolaskar and Tongaonkar. Kolaskar, A S and Tongaonkar, P C., A semi-empirical method for prediction of antigenic determinants on protein antigens, *FEBS Letters* 276: 172-174 (1990). Examples of post-translational modifications (PTMs) and other motifs of the OSPs of this invention are listed below. In addition, antibodies that specifically bind such post-translational modifications may be useful as a diagnostic or as therapeutic. The PTMs and other motifs were predicted by using the ProSite Dictionary of Proteins Sites and Patterns (Bairoch et al., *Nucleic Acids Res.* 25(1):217-221 (1997)), the following motifs, including PTMs, were predicted for the OSPs of the invention. The signal peptides were detected by using the SignalP 2.0, see Nielsen et al., *Protein Engineering* 12, 3-9 (1999). Prediction of transmembrane helices in proteins was performed by the application TMHMM 2.0, "currently the best performing transmembrane prediction program", according to authors (Krogh et al., *Journal of Molecular Biology*, 305(3):567-580, (2001); Moller et al., *Bioinformatics*, 17(7):646-653, (2001); Sonnhammer, et al., *A hidden Markov model for predicting transmembrane helices in protein sequences* in Glasgow, et al. Ed. *Proceedings of the Sixth International Conference on Intelligent Systems for Molecular Biology*, pages 175-182, Menlo Park, Calif., 1998. AAAI Press. The PSORT II program may also be used to predict cellular localizations. Horton et al., *Intelligent Systems for Molecular Biology* 5: 147-152 (1997). The table below includes the following sequence annotations: Signal peptide presence; TM (number of membrane domain, topology in orientation and position); Amino acid location and antigenic index (location, AI score, length); PTM and other motifs (type, amino acid residue locations); and functional domains.

| AA SEQ ID | Sig P | TMHMM | Antigenicity | PTM | Domain |
|---|---|---|---|---|---|
| DEX0443_001.aa.1 | Y | 0-o | 4-25, 1.252 | | |
| DEX0443_002.aa.1 | y | 0-i | 70-79, 1.158; 94-105, 1.153; 17-55, 1.125; 59-67, 1.082 | Myristyl 62-67, 77-82, 87-92, 91-96, 94-99; Pkc_Phospho_Site 12-14; Prokar_Lipoprotein 68-78; | |
| DEX0443_002.aa.3 | y | 0-i | 70-79, 1.158; 94-105, 1.153; 17-55, 1.125; 59-67, 1.082 | Myristyl 62-67, 77-82, 87-92, 91-96, 94-99; Pkc_Phospho_Site 12-14; Prokar_Lipoprotein 68-78; | |
| DEX0443_003.aa.1 | N | 0-o | 51-60, 1.178; 62-68, 1.130; 30-45, 1.109 | Asn_Glycosylation 19-22; Ck2_Phospho_Site 60-63, 64-67; Myristyl 17-22, 41-46, 54-59; Pkc_Phospho_Site 47-49; | Lipocalin-related protein and Bos/Can/Equ allergen |
| DEX0443_003.aa.2 | N | 0-o | 4-15, 1.178; 58-67, 1.178; 69-81, 1.149; 105-114, 1.123; 94-100, 1.080; 37-52, 1.076 | Asn_Glycosylation 26-29; Ck2_Phospho_Site 67-70, 71-74; Myristyl 24-29, 48-53, 61-66; Pkc_Phospho_Site 54-56, 89-91, 118-120; | Lipocalin-related protein and Bos/Can/Equ allergen |
| DEX0443_004.aa.1 | N | 0-o | 52-62, 1.259; 16-24, 1.148; 191-210, 1.133; 151-159, 1.116; 6-14, 1.107; 33-39, 1.106; 90-100, 1.098; 161-166, 1.073; 118-128, 1.067; 104-110, 1.059; 79-86, 1.058; 225-231, 1.043 | Asn_Glycosylation 29-32; 144-147, 171-174, 174-177, 207-210; Ck2_Phospho_Site 35-38, 64-67, 100-103, 164-167, 176-179; Glycosaminoglycan 31-34; Myristyl 59-64; Pkc_Phospho_Site 21-23, 64-66, 223-225, 236-238; | |

-continued

| AA SEQ ID | Sig P | TMHMM | Antigenicity | PTM | Domain |
|---|---|---|---|---|---|
| DEX0443_004.aa.3 | N | 5-<br>i21-43o56-78i189-211o266-288i295-317o | 141-213, 1.251;<br>753-782, 1.251;<br>570-587, 1.245;<br>52-80, 1.244;<br>655-680, 1.230;<br>292-319, 1.220;<br>21-46, 1.201;<br>531-544, 1.196;<br>624-652, 1.188;<br>121-132, 1.185;<br>884-898, 1.185;<br>787-805, 1.180;<br>818-881, 1.176;<br>589-601, 1.168;<br>348-380, 1.166;<br>609-619, 1.166;<br>721-739, 1.162;<br>99-116, 1.162;<br>512-524, 1.154;<br>255-286, 1.151;<br>321-340, 1.148;<br>409-462, 1.144;<br>492-507, 1.141;<br>924-935, 1.123;<br>243-252, 1.116;<br>4-19, 1.116;<br>84-92, 1.108;<br>388-401, 1.100;<br>551-568, 1.095;<br>914-920, 1.094;<br>691-697, 1.081;<br>810-816, 1.062;<br>700-708, 1.061 | Asn_Glycosylation<br>56-59, 233-236,<br>746-749,<br>752-755, 787-790;<br>Ck2_Phospho_Site<br>508-511, 551-554,<br>702-705,<br>719-722, 884-887,<br>909-912,<br>939-942, 941-944;<br>Myristyl<br>135-140, 245-250,<br>656-661,<br>700-705;<br>Pkc_Phospho_Site<br>3-5, 144-146,<br>166-168, 235-237,<br>264-266,<br>322-324, 337-339,<br>356-358,<br>551-553, 627-629,<br>721-723,<br>760-762, 789-791,<br>813-815,<br>840-842, 884-886,<br>909-911,<br>914-916, 917-919,<br>943-945;<br>Tyr_Phospho_Site<br>302-308;<br>Prokar_Lipoprotein<br>664-674; | |
| DEX0443_004.aa.4 | N | 6-<br>o130-149i169-191o206-228i340-362o417-439i446-468o | 292-364, 1.251;<br>203-243, 1.244;<br>126-152, 1.243;<br>443-470, 1.220;<br>172-197, 1.201;<br>74-83, 1.196;<br>9-27, 1.196;<br>250-283, 1.185;<br>659-673, 1.185;<br>94-120, 1.182;<br>38-69, 1.174;<br>499-531, 1.166;<br>406-437, 1.151;<br>472-491, 1.148;<br>560-613, 1.144;<br>699-710, 1.123;<br>643-656, 1.122;<br>394-403, 1.116;<br>162-170, 1.116;<br>538-552, 1.100;<br>689-695, 1.094;<br>154-160, 1.051 | Asn_Glycosylation<br>125-128, 207-210,<br>384-387;<br>Ck2_Phospho_Site<br>37-40, 118-121,<br>659-662, 684-687,<br>714-717,<br>716-719;<br>Myristyl 286-291,<br>396-401;<br>Pkc_Phospho_Site<br>7-9, 95-97, 158-160,<br>295-297,<br>317-319, 386-388,<br>415-417,<br>473-475, 488-490,<br>507-509,<br>659-661, 684-686,<br>689-691,<br>692-694, 718-720;<br>Tyr_Phospho_Site<br>453-459; | |
| DEX0443_006.aa.1 | N | 0-o | 140-148, 1.140;<br>4-21, 1.126;<br>52-70, 1.119;<br>37-46, 1.108;<br>74-87, 1.101;<br>111-121, 1.089;<br>100-107, 1.088;<br>93-98, 1.082;<br>123-132, 1.074 | Amidation 140-143;<br>Asn_Glycosylation<br>34-37, 95-98;<br>Ck2_Phospho_Site<br>64-67;<br>Glycosaminoglycan<br>53-56;<br>Myristyl 44-49,<br>98-103, 137-142;<br>Pkc_Phospho_Site<br>74-76, 133-135; | |
| DEX0443_006.aa.3 | N | 0-o | 36-61, 1.137;<br>20-26, 1.110 | Asn_Glycosylation<br>70-73;<br>Ck2_Phospho_Site<br>5-8, 9-12, 34-37,<br>49-52, 66-69; | |

-continued

| AA SEQ ID | Sig P | TMHMM | Antigenicity | PTM | Domain |
|---|---|---|---|---|---|
| DEX0443_006.aa.4 | N | 0-o | 94-113, 1.218; 38-54, 1.123; 26-32, 1.099; 71-78, 1.079; 84-89, 1.031 | Asn__Glycosylation 39-42; Ck2__Phospho__Site 7-10, 13-16, 41-44, 63-66, 74-77; Pkc__Phospho__Site 74-76; | |
| DEX0443_006.aa.5 | Y | 0-o | 4-25, 1.193; 77-90, 1.180; 109-124, 1.117; 43-58, 1.096; 60-65, 1.063; 28-36, 1.061 | Ck2__Phospho__Site 16-19, 82-85; Myristyl 116-121; | |
| DEX0443_006.aa.6 | N | 0-o | 94-105, 1.208; 28-46, 1.188; 78-85, 1.142; 117-127, 1.097; 60-74, 1.085 | Amidation 9-12; Asn__Glycosylation 63-66; Ck2__Phospho__Site 61-64, 113-116; Pkc__Phospho__Site 52-54; Aa__Trna__Ligase__Ii_1 27-49; | Aminoacyl-transfer RNA synthetases class-II |
| DEX0443_007.aa.1 | N | 0-i | 21-29, 1.168; 63-80, 1.159; 103-111, 1.144; 82-96, 1.123; 148-157, 1.113; 54-60, 1.086; 135-143, 1.070; 125-133, 1.062 | Amidation 9-12; Camp__Phospho__Site 13-16; Ck2__Phospho__Site 149-152; Myristyl 79-84, 88-93; Pkc__Phospho__Site 20-22, 59-61, 67-69, 74-76, 149-151; Ribosomal__L21e 43-68; | Ribosomal protein L21E |
| DEX0443_007.aa.2 | y | 1-i30-52o | 146-164, 1.228; 166-191, 1.222; 39-67, 1.208; 116-133, 1.183; 75-85, 1.175; 9-34, 1.171; 100-114, 1.115 | Asn__Glycosylation 93-96, 117-120, 141-144; Ck2__Phospho__Site 58-61; Myristyl 42-47, 138-143; Pkc__Phospho__Site 146-148, 176-178; | |
| DEX0443_008.aa.1 | N | 0-o | 50-67, 1.164; 35-48, 1.140; 4-12, 1.093; 16-22, 1.087 | Ck2__Phospho__Site 15-18; | |
| DEX0443_009.aa.1 | N | 0-o | 71-83, 1.182; 90-97, 1.134; 211-219, 1.127; 130-141, 1.117; 186-193, 1.076; 59-65, 1.067; 195-202, 1.065; 226-240, 1.059; 169-177, 1.041 | Asn__Glycosylation 13-16, 40-43; Ck2__Phospho__Site 119-122, 125-128, 149-152, 162-165, 214-217, 225-228; Myristyl 134-139; Pkc__Phospho__Site 105-107, 173-175; Rgd 93-95; Tyr__Phospho__Site 109-115; | Osteopontin; NULL |
| DEX0443_010.aa.1 | y | 0-o | 4-37, 1.173; 44-55, 1.085 | Ck2__Phospho__Site 15-18; | |
| DEX0443_011.aa.1 | N | 0-o | 23-35, 1.178; 213-239, 1.178; 140-168, 1.155; 241-249, 1.130; 290-299, 1.123; 195-211, 1.089; | Asn__Glycosylation 19-22, 46-49, 137-140; Ck2__Phospho__Site 77-80, 139-142, 239-242, 243-246; | Lipocalin-related protein and Bos/Can/Equ allergen; Lipocalin |

-continued

| AA SEQ ID | Sig P | TMHMM | Antigenicity | PTM | Domain |
|---|---|---|---|---|---|
| | | | 279-285, 1.080; 57-71, 1.076; 100-106, 1.070; 170-176, 1.068; 79-89, 1.060; 8-15, 1.052; 261-266, 1.025 | Myristyl 15-20, 44-49, 68-73, 92-97, 97-102, 101-106, 115-120, 233-238; Pkc_Phospho_Site 74-76, 77-79, 119-121, 188-190, 212-214, 274-276, 303-305; | |
| DEX0443_011.aa.2 | y | 0-o | 45-70, 1.189; 97-109, 1.178; 187-196, 1.178; 15-38, 1.169; 198-206, 1.130; 247-256, 1.123; 236-242, 1.080; 131-145, 1.076; 174-180, 1.070; 6-12, 1.064; 153-163, 1.060; 82-89, 1.052; 218-223, 1.025 | Asn_Glycosylation 93-96, 120-123; Ck2_Phospho_Site 151-154, 196-199, 200-203; Myristyl 89-94, 118-123, 142-147, 166-171, 171-176, 175-180, 186-191, 190-195; Pkc_Phospho_Site 7-9, 148-150, 151-153, 231-233, 260-262; Lipocalin 75-88; | Lipocalin-related protein and Bos/Can/Equ allergen |
| DEX0443_011.aa.3 | N | 0-o | 45-70, 1.189; 320-332, 1.178; 375-384, 1.178; 15-38, 1.169; 386-394, 1.130; 435-444, 1.123; 178-185, 1.121; 132-150, 1.107; 230-238, 1.082; 424-430, 1.080; 354-369, 1.076; 108-114, 1.075; 97-102, 1.067; 268-277, 1.065; 6-12, 1.064; 305-312, 1.052; 255-261, 1.049; 87-93, 1.037; 166-172, 1.033; 406-411, 1.025 | Amidation 128-131, 298-301; Asn_Glycosylation 268-271, 316-319, 343-346; Ck2_Phospho_Site 219-222, 384-387, 388-391; Glycosaminoglycan 287-290; Myristyl 104-109, 121-126, 196-201, 210-215, 212-217, 213-218, 228-233, 232-237, 278-283, 298-303, 312-317, 341-346, 365-370, 378-383; Pkc_Phospho_Site 7-9, 88-90, 100-102, 110-112, 125-127, 204-206, 258-260, 371-373, 419-421, 448-450; Lipocalin 298-311, 299-311; | Lipocalin-related protein and Bos/Can/Equ allergen; Lipocalin; Prostaglandin D synthase |
| DEX0443_011.aa.4 | N | 0-o | 418-433, 1.295; 263-275, 1.199; 45-70, 1.189; 15-38, 1.169; 200-209, 1.156; 159-172, 1.150; 407-413, 1.106; 397-405, 1.106; 382-388, 1.103; 219-225, 1.098; 436-444, 1.088; 318-325, 1.078; 108-114, 1.075; 132-149, 1.075; 345-354, 1.074; 329-335, 1.068; 97-102, 1.067; 6-12, 1.064; 237-242, 1.056; 87-93, 1.037; 246-252, 1.033 | Amidation 128-131, 231-234, 327-330, 381-384; Camp_Phospho_Site 233-236; Ck2_Phospho_Site 261-264; Myristyl 104-109, 121-126, 190-195, 195-200, 198-203, 200-205, 228-233, 280-285, 288-293, 290-295, 292-297, 293-298, 306-311, 316-321, 324-329, 341-346, 346-351, 360-365, 364-369, 368-373, 372-377, 378-383; | NULL |

-continued

| AA SEQ ID | Sig P | TMHMM | Antigenicity | PTM | Domain |
|---|---|---|---|---|---|
| | | | | Pkc_Phospho_Site 7-9, 88-90, 100-102, 110-112, 125-127, 178-180, 184-186, 220-222, 231-233, 248-250; | |
| DEX0443_011.aa.5 | y | 0-o | 46-89, 1.223; 8-36, 1.181; 120-129, 1.123; 109-115, 1.080; 38-44, 1.052 | Asn_Glycosylation 98-101; Myristyl 26-31, 59-64, 76-81; Pkc_Phospho_Site 104-106, 133-135; Prokar_Lipoprotein 50-60; | Lipocalin-related protein and Bos/Can/Equ allergen |
| DEX0443_011.aa.6 | N | 0-o | 75-102, 1.154; 11-27, 1.137; 110-116, 1.090; 38-45, 1.081; 47-53, 1.067; 137-147, 1.065 | Asn_Glycosylation 76-79; Ck2_Phospho_Site 51-54; Myristyl 56-61, 67-72, 70-75, 74-79, 79-84, 110-115, 120-125, 143-148; Pkc_Phospho_Site 38-40, 121-123; | |
| DEX0443_011.aa.7 | N | 0-o | 45-70, 1.189; 97-109, 1.178; 152-161, 1.178; 15-38, 1.169; 163-171, 1.130; 212-221, 1.123; 201-207, 1.080; 131-146, 1.076; 6-12, 1.064; 82-89, 1.052; 183-188, 1.025 | Asn_Glycosylation 93-96, 120-123; Ck2_Phospho_Site 161-164, 165-168; Myristyl 89-94, 118-123, 142-147, 155-160; Pkc_Phospho_Site 7-9, 148-150, 196-198, 225-227; Lipocalin 75-88; | Lipocalin-related protein and Bos/Can/Equ allergen; Lipocalin; Prostaglandin D synthase |
| DEX0443_012.aa.2 | N | 0-o | 113-119, 1.127; 32-43, 1.117; 88-95, 1.076; 97-104, 1.065; 71-79, 1.049 | Ck2_Phospho_Site 5-8, 21-24, 27-30, 51-54, 64-67, 116-119; Myristyl 36-41; Pkc_Phospho_Site 75-77; | |
| DEX0443_014.aa.1 | N | 0-o | 4-11, 1.149; 45-54, 1.095; 29-34, 1.048 | Asn_Glycosylation 24-27; Camp_Phospho_Site 42-45; Ck2_Phospho_Site 26-29, 54-57; Myristyl 19-24, 50-55; | Aminopeptidase N, APN (CD13) |
| DEX0443_014.aa.2 | N | 0-o | 69-80, 1.147; 4-13, 1.110; 27-37, 1.085; 50-61, 1.080; 82-89, 1.049 | Amidation 44-47; Camp_Phospho_Site 53-56, 59-62; Ck2_Phospho_Site 41-44; Pkc_Phospho_Site 48-50, 52-54, 57-59, 62-64, 102-104, 106-108; | |
| DEX0443_014.aa.3 | N | 0-o | 35-53, 1.229; 9-19, 1.088; 22-32, 1.087 | Asn_Glycosylation 56-59; Ck2_Phospho_Site 23-26; Tyr_Phospho_Site 32-40; | |
| DEX0443_014.aa.4 | N | 0-o | 87-110, 1.192; 4-14, 1.156; 53-64, 1.118; 44-50, 1.089; 76-82, 1.081; 117-125, 1.081; 67-74, 1.056 | Camp_Phospho_Site 22-25; | |

-continued

| AA SEQ ID | Sig P | TMHMM | Antigenicity | PTM | Domain |
|---|---|---|---|---|---|
| DEX0443_015.aa.3 | y | 0-o | 27-34, 1.140; 4-11, 1.096; 16-22, 1.068; 38-44, 1.033 | Amidation 52-55; Asn_Glycosylation 60-63; Camp_Phospho_Site 84-87; Ck2_Phospho_Site 87-90; Glycosaminoglycan 42-45; Myristyl 43-48; Pkc_Phospho_Site 63-65; | |
| DEX0443_016.aa.1 | Y | 1-o252-274i | 251-283, 1.275; 216-228, 1.194; 180-192, 1.149; 61-71, 1.145; 6-32, 1.142; 96-114, 1.119; 172-178, 1.104; 142-160, 1.096; 38-43, 1.087; 236-242, 1.071; 79-84, 1.064; 88-94, 1.049 | Tissue_Factor 82-99; Amidation 200-203; Asn_Glycosylation 48-51, 161-164; 174-177; Camp_Phospho_Site 237-240; Ck2_Phospho_Site 58-61, 90-93, 92-95, 125-128, 163-166, 179-182, 242-245, 290-293; Myristyl 36-41, 39-44, 118-123, 157-162, 248-253, 286-291; Pkc_Phospho_Site 50-52, 76-78, 179-181, 200-202, 204-206, 290-292; | Cytokine receptor class 2 family; Tissue Factor (TF) |
| DEX0443_016.aa.2 | Y | 0-o | 52-64, 1.179; 42-49, 1.142; 6-33, 1.142 | Glycosaminoglycan 38-41; Myristyl 39-44, 43-48, 47-52; | |
| DEX0443_016.aa.3 | Y | 1-i21-43o | 4-44, 1.209; 61-73, 1.179; 51-58, 1.142 | Myristyl 5-10, 39-44, 48-53, 52-57, 56-61; Pkc_Phospho_Site 13-15; | |
| DEX0443_020.aa.1 | N | 0-o | 14-47, 1.175; 76-98, 1.143; 119-126, 1.128; 49-57, 1.127; 109-116, 1.077; 101-107, 1.061; 6-12, 1.051; 66-73, 1.035 | Myristyl 107-112; Pkc_Phospho_Site 27-29, 51-53; | |
| DEX0443_020.aa.3 | N | 0-o | 14-47, 1.175; 76-98, 1.143; 119-126, 1.128; 49-57, 1.127; 109-116, 1.077; 101-107, 1.061; 6-12, 1.051; 66-73, 1.035 | Myristyl 107-112; Pkc_Phospho_Site 27-29, 51-53; | |
| DEX0443_021.aa.1 | Y | 0-o | 4-20, 1.253; 22-31, 1.067 | Asn_Glycosylation 53-56; Ck2_Phospho_Site 23-26; Myristyl 51-56; | |
| DEX0443_021.aa.3 | N | 3-o47-69i215-237o252-270i | 11-83, 1.303; 208-289, 1.280; 117-193, 1.233; 293-319, 1.228; 86-110, 1.216; 4-9, 1.137; 200-206, 1.064 | Myristyl 136-141; | NULL |

-continued

| AA SEQ ID | Sig P | TMHMM | Antigenicity | PTM | Domain |
|---|---|---|---|---|---|
| DEX0443_021.aa.5 | Y | 0-o | 4-32, 1.295; 103-115, 1.061; 160-169, 1.056; 205-221, 1.055; 79-85, 1.048; 301-308, 1.028; 233-241, 1.010 | Ck2_Phospho_Site 23-26, 174-177; Myristyl 101-106, 119-124, 170-175, 182-187, 194-199, 293-298; Pkc_Phospho_Site 148-150; Rgd 259-261; | Collagen triple helix repeat; Proline-rich region; NULL |
| DEX0443_021.aa.6 | N | 0-o | 646-660, 1.144; 628-641, 1.128; 544-554, 1.110; 692-699, 1.106; 605-617, 1.081; 569-594, 1.071; 255-261, 1.068; 486-496, 1.063; 202-211, 1.049; 45-60, 1.049; 436-445, 1.049; 151-159, 1.048; 112-118, 1.036; 670-676, 1.030; 375-381, 1.025; 682-689, 1.023; 174-187, 1.022; 12-27, 1.022; 535-540, 1.017; 133-139, 1.010; 511-520, 1.010; 327-333, 1.001 | Ck2_Phospho_Site 275-278, 362-365, 559-562, 612-615, 683-686; Myristyl 118-123, 121-126, 124-129, 127-132, 130-135, 151-156, 163-168, 196-201, 214-219, 232-237, 262-267, 283-288, 349-354, 432-437, 448-453, 453-458, 475-480, 499-504, 511-516, 541-546, 563-568; Pkc_Phospho_Site 39-41, 366-368, 546-548, 559-561, 588-590, 605-607, 612-614; Gram_Pos_Anchoring 449-454; | Collagen triple helix repeat; Proline-rich region; Fibrillar collagen C-terminal domain; Gram-positive cocci surface protein 'anchoring' hexapeptide; NULL |
| DEX0443_022.aa.2 | N | 0-o | 4-11, 1.131; 15-23, 1.096; 45-51, 1.090 | Glycosaminoglycan 81-84; | |
| DEX0443_022.aa.3 | N | 0-o | 239-267, 1.186; 13-34, 1.181; 209-218, 1.167; 309-318, 1.162; 179-186, 1.153; 73-108, 1.131; 290-300, 1.120; 121-147, 1.118; 4-10, 1.110; 193-199, 1.098; 169-175, 1.090; 112-119, 1.083; 46-55, 1.071; 341-347, 1.071 | Amidation 222-225, 330-333; Asn_Glycosylation 113-116; Camp_Phospho_Site 83-86; Ck2_Phospho_Site 23-26, 49-52; Myristyl 195-200, 208-213, 268-273; Pkc_Phospho_Site 53-55, 61-63; | NAD dependent epimerase/dehydratase family |
| DEX0443_022.aa.4 | N | 0-o | 337-393, 1.213; 239-267, 1.186; 399-417, 1.182; 13-34, 1.181; 209-218, 1.167; 309-318, 1.162; 179-186, 1.153; 422-434, 1.145; 73-108, 1.131; 290-300, 1.120; 121-147, 1.118; 4-10, 1.110; 193-199, 1.098; 169-175, 1.090; 112-119, 1.083; 46-55, 1.071 | Amidation 222-225, 330-333; Asn_Glycosylation 113-116; Camp_Phospho_Site 83-86; Ck2_Phospho_Site 23-26, 49-52; Glycosaminoglycan 465-468; Myristyl 195-200, 208-213, 268-273, 364-369; Pkc_Phospho_Site 53-55, 61-63, 351-353, 377-379, 404-406; | NAD dependent epimerase/dehydratase family |

-continued

| AA SEQ ID | Sig P | TMHMM | Antigenicity | PTM | Domain |
|---|---|---|---|---|---|
| DEX0443_022.aa.5 | N | 0-o | 239-267, 1.186; 13-34, 1.181; 209-218, 1.167; 309-318, 1.162; 179-186, 1.153; 73-108, 1.131; 290-300, 1.120; 121-147, 1.118; 4-10, 1.110; 193-199, 1.098; 169-175, 1.090; 112-119, 1.083; 46-55, 1.071 | Amidation 222-225; Asn_Glycosylation 113-116; Camp_Phospho_Site 83-86; Ck2_Phospho_Site 23-26, 49-52; Myristyl 195-200, 208-213, 268-273; Pkc_Phospho_Site 53-55, 61-63; | NAD dependent epimerase/dehydratase family |
| DEX0443_022.aa.6 | N | 0-o | 59-74, 1.132; 11-37, 1.118 | | |
| DEX0443_023.aa.1 | N | 1-o236-258i | 235-261, 1.187; 165-177, 1.167; 5-24, 1.165; 196-228, 1.160; 63-84, 1.157; 138-147, 1.152; 96-124, 1.126; 46-52, 1.097; 179-193, 1.083; 154-160, 1.064 | Asn_Glycosylation 40-43, 58-61, 132-135; Ck2_Phospho_Site 46-49, 107-110; Myristyl 247-252; Pkc_Phospho_Site 140-142, 153-155; Lamp_1 61-75; | Lysosome-associated membrane glycoprotein (Lamp)/CD68 |
| DEX0443_023.aa.2 | y | 0-o | 5-24, 1.165; 63-84, 1.157; 96-127, 1.144; 139-145, 1.100; 46-52, 1.097; 156-162, 1.056 | Asn_Glycosylation 40-43, 58-61; Ck2_Phospho_Site 46-49, 107-110; Myristyl 137-142, 159-164; Pkc_Phospho_Site 169-171; Lamp_1 61-75; | Lysosome-associated membrane glycoprotein (Lamp)/CD68 |
| DEX0443_023.aa.3 | y | 0-o | 5-24, 1.165; 58-87, 1.147; 46-52, 1.097 | Asn_Glycosylation 40-43, 58-61; Ck2_Phospho_Site 46-49; Myristyl 75-80; | |
| DEX0443_023.aa.4 | N | 1-o236-258i | 235-261, 1.187; 165-177, 1.167; 5-24, 1.165; 196-228, 1.160; 63-84, 1.157; 138-147, 1.152; 96-124, 1.126; 46-52, 1.097; 179-193, 1.083; 154-160, 1.064 | Asn_Glycosylation 40-43, 58-61, 132-135; Ck2_Phospho_Site 46-49, 107-110; Myristyl 247-252; Pkc_Phospho_Site 140-142, 153-155; Lamp_1 61-75; | Lysosome-associated membrane glycoprotein (Lamp)/CD68 |
| DEX0443_023.aa.6 | N | 1-o277-299i | 276-302, 1.187; 206-218, 1.167; 5-24, 1.165; 237-269, 1.160; 63-84, 1.157; 179-188, 1.152; 96-127, 1.144; 139-145, 1.100; 46-52, 1.097; 220-234, 1.083; 195-201, 1.064 | Asn_Glycosylation 40-43, 58-61, 173-176; Camp_Phospho_Site 162-165; Ck2_Phospho_Site 46-49, 107-110; Myristyl 137-142, 288-293; Pkc_Phospho_Site 181-183, 194-196; Lamp_1 61-75; | Lysosome-associated membrane glycoprotein (Lamp)/CD68 |
| DEX0443_023.aa.7 | N | 1-o329-351i | 4-32, 1.238; 328-354, 1.187; 258-270, 1.167; 289-321, 1.160; 156-177, 1.157; 38-61, 1.154; 231-240, 1.152; 73-122, 1.145; 189-217, 1.126; 139-145, 1.097; 272-286, 1.083; 247-253, 1.064 | Amidation 56-59; Asn_Glycosylation 151-154, 225-228; Ck2_Phospho_Site 139-142, 200-203; Myristyl 37-42, 39-44, 88-93, 340-345; Pkc_Phospho_Site 7-9, 18-20, 233-235, 246-248; Lamp_1 154-168; | Lysosome-associated membrane glycoprotein (Lamp)/CD68 |

-continued

| AA SEQ ID | Sig P | TMHMM | Antigenicity | PTM | Domain |
|---|---|---|---|---|---|
| DEX0443_025.aa.1 | Y | 0-o | 351-360, 1.285; 4-15, 1.269; 101-117, 1.189; 150-164, 1.148; 300-310, 1.144; 264-294, 1.134; 19-35, 1.134; 184-200, 1.124; 332-340, 1.123; 207-220, 1.112; 245-253, 1.109; 312-319, 1.085; 67-73, 1.074; 119-138, 1.065; 90-96, 1.060; 238-243, 1.051; 38-45, 1.048; 229-235, 1.042; 174-179, 1.036 | Asp_Protease 98-109; Asn_Glycosylation 95-98; Ck2_Phospho_Site 70-73, 173-176, 180-183, 226-229, 302-305, 331-334, 345-348, 353-356; Myristyl 137-142, 147-152, 151-156, 167-172, 230-235; Pkc_Phospho_Site 36-38, 70-72, 277-279, 353-355, 365-367; Crystallin_Betagamma 238-253; Prokar_Lipoprotein 268-278; | Crystallin; Pepsin (A1) aspartic protease; Eukaryotic and viral aspartic protease active site |
| DEX0443_026.aa.3 | Y | 4-i7-29o44-61i81-98o113-135i | 10-59, 1.254; 111-139, 1.227; 80-104, 1.210; 235-243, 1.169; 212-228, 1.151; 246-265, 1.150; 267-275, 1.083; 162-168, 1.063; 174-180, 1.045 | Asn_Glycosylation 200-203; Glycosaminoglycan 149-152; Myristyl 86-91, 96-101, 123-128, 128-133, 226-231, 233-238; Pkc_Phospho_Site 72-74, 172-174; | Cation efflux family; NULL |
| DEX0443_027.aa.1 | N | 0-o | 4-16, 1.200; 118-136, 1.135; 53-70, 1.121; 84-100, 1.118; 76-82, 1.087; 163-172, 1.086; 105-111, 1.072; 18-35, 1.070 | Thioredoxin 91-109; Ck2_Phospho_Site 157-160, 166-169; Myristyl 16-21, 27-32, 42-47, 53-58; Pkc_Phospho_Site 37-39, 43-45, 148-150; | Thioredoxin |
| DEX0443_028.aa.1 | N | 0-o | 4-23, 1.166; 53-62, 1.137; 25-32, 1.076 | Camp_Phospho_Site 36-39; Myristyl 71-76; | |
| DEX0443_028.aa.3 | N | 0-o | 119-149, 1.197; 32-87, 1.174; 17-23, 1.109; 89-95, 1.106; 4-11, 1.100; 104-110, 1.031 | Amidation 121-124; Glycosaminoglycan 15-18; Myristyl 16-21, 62-67, 93-98, 96-101, 114-119; Pkc_Phospho_Site 37-39; Prokar_Lipoprotein 73-83; | |
| DEX0443_030.aa.1 | N | 0-i | 9-21, 1.314; 25-39, 1.158 | Ck2_Phospho_Site 40-43; Pkc_Phospho_Site 3-5; | |
| DEX0443_030.aa.2 | N | 1-o15-37i | 163-194, 1.164; 148-161, 1.149; 97-111, 1.142; 69-86, 1.136; 129-145, 1.136; 34-54, 1.104; 13-26, 1.100 | Ck2_Phospho_Site 87-90, 116-119, 148-151; Myristyl 142-147, 191-196; Pkc_Phospho_Site 45-47; | Binding-protein-dependent transport systems inner membrane component; MAPEG (Membrane-associated proteins in eicosanoid and glutathione metabolism); NULL |
| DEX0443_030.aa.3 | N | 1-i55-77o | 109-126, 1.136; 137-143, 1.135; 9-16, 1.114; 74-94, 1.104; 53-66, 1.100; 41-47, 1.090; 24-36, 1.061 | Ck2_Phospho_Site 41-44, 127-130; Pkc_Phospho_Site 23-25, 85-87; | NULL |

-continued

| AA SEQ ID | Sig P | TMHMM | Antigenicity | PTM | Domain |
|---|---|---|---|---|---|
| DEX0443_030.aa.4 | N | 1-i55-77o | 171-179, 1.124; 9-16, 1.114; 74-94, 1.104; 148-154, 1.101; 53-66, 1.100; 41-47, 1.090; 126-134, 1.087; 24-36, 1.061 | Asn_Glycosylation 137-140; Ck2_Phospho_Site 41-44, 139-142; Myristyl 171-176; Pkc_Phospho_Site 23-25, 85-87, 161-163, 164-166; | NULL |
| DEX0443_030.aa.5 | N | 0-o | 4-87, 1.251; 104-112, 1.142; 96-102, 1.056 | Pkc_phospho_Site 41-43; | Immunoglobulin and major histocompatibility complex domain |
| DEX0443_030.aa.6 | N | 1-i55-77o | 118-145, 1.168; 9-16, 1.114; 74-94, 1.104; 53-66, 1.100; 41-47, 1.090; 109-115, 1.089; 24-36, 1.061 | Ck2_Phospho_Site 41-44; Pkc_Phospho_Site 23-25, 85-87; | NULL |
| DEX0443_030.aa.7 | N | 1-i55-77o | 9-16, 1.114; 53-66, 1.100; 41-47, 1.090; 24-36, 1.061; 74-80, 1.059 | Ck2_Phospho_Site 41-44; Pkc_Phospho_Site 23-25, 85-87; | |
| DEX0443_030.aa.8 | N | 0-o | 60-111, 1.149; 41-57, 1.136; 9-16, 1.114; 24-37, 1.082 | Ck2_Phospho_Site 60-63; Myristyl 54-59, 103-108; Pkc_Phospho_Site 23-25; | MAPEG (Membrane-associated proteins in eicosanoid and glutathione metabolism); NULL |
| DEX0443_030.aa.9 | y | 0-o | 20-44, 1.247; 91-142, 1.149; 72-88, 1.136; 10-17, 1.098; 59-65, 1.060 | Ck2_Phospho_Site 91-94; Myristyl 26-31, 85-90, 134-139; | MAPEG (Membrane-associated proteins in eicosanoid and glutathione metabolism); NULL |
| DEX0443_032.aa.2 | N | 1-i38-60o | 331-347, 1.304; 38-70, 1.234; 108-123, 1.200; 470-502, 1.191; 355-365, 1.166; 504-520, 1.149; 253-271, 1.143; 77-100, 1.134; 160-177, 1.121; 219-235, 1.118; 461-468, 1.117; 298-308, 1.100; 211-217, 1.087; 314-320, 1.087; 19-33, 1.079; 442-448, 1.077; 240-246, 1.072; 125-142, 1.070; 408-414, 1.067; 198-204, 1.052; 434-440, 1.032 | Thioredoxin 91-109, 226-244; Ck2_Phospho_Site 66-69, 67-70, 202-205, 292-295, 301-304, 334-337, 359-362, 387-390, 419-422, 449-452; Myristyl 20-25, 51-56, 63-68, 123-128, 134-139, 149-154, 160-165, 184-189, 188-193, 445-450, 466-471, 498-503, 502-507; Pkc_Phospho_Site 37-39, 144-146, 150-152, 192-194, 201-203, 202-204, 283-285, 508-510; Prokar_Lipoprotein 45-55; | Thioredoxin |
| DEX0443_033.aa.1 | N | 0-o | 9-21, 1.183; 162-173, 1.135; 135-147, 1.124; 333-358, 1.121; 307-315, 1.097; 68-80, 1.085; 196-208, 1.074; 82-104, 1.070; 319-325, 1.056 | | RNA-binding protein C2H2 Zn-finger domain; WW/rsp5/WWP domain; U1-like zinc finger |

-continued

| AA SEQ ID | Sig P | TMHMM | Antigenicity | PTM | Domain |
|---|---|---|---|---|---|
| DEX0443_033.aa.2 | N | 0-o | 356-398, 1.245; 423-436, 1.239; 26-43, 1.189; 131-145, 1.184; 589-599, 1.174; 45-56, 1.173; 210-228, 1.167; 492-538, 1.161; 438-455, 1.150; 540-559, 1.135; 237-249, 1.127; 82-90, 1.126; 282-289, 1.113; 465-474, 1.113; 4-17, 1.107; 328-338, 1.106; 268-280, 1.098; 340-347, 1.087; 412-421, 1.071; 481-489, 1.069; 63-71, 1.063; 312-318, 1.061; 153-159, 1.060; 603-608, 1.050 | Amidation 181-184; Asn_Glycosylation 198-201, 329-332, 417-420, 522-525; Camp_Phospho_Site 576-579; Ck2_Phospho_Site 69-72, 93-96, 131-134, 132-135, 172-175, 236-239, 311-314, 410-413; Myristyl 341-346, 344-349, 353-358, 497-502, 555-560; Pkc_Phospho_Site 200-202, 236-238, 326-328, 331-333, 422-424, 437-439, 468-470, 493-495, 543-545, 587-589; Tyr_Phospho_Site 259-266; Ets_Domain_1 215-223; Ets_Domain_2 261-276; | Ets-domain; HSF/ETS DNA-binding domain; NULL |
| DEX0443_033.aa.3 | y | 0-o | 96-115, 1.189; 145-161, 1.189; 28-44, 1.177; 9-18, 1.140; 51-57, 1.103; 63-71, 1.086; 117-127, 1.085 | Amidation 62-65; Ck2_Phospho_Site 147-150; Myristyl 35-40, 39-44, 72-77, 159-164; Pkc_Phospho_Site 25-27, 62-64; | |
| DEX0443_034.aa.2 | N | 0-o | 44-68, 1.254; 140-149, 1.164; 327-336, 1.136; 353-358, 1.128; 70-78, 1.121; 5-11, 1.110; 228-246, 1.106; 164-172, 1.079; 206-212, 1.074; 24-30, 1.067; 295-301, 1.064; 274-283, 1.059; 118-124, 1.053; 261-267, 1.047; 184-189, 1.046; 155-160, 1.034 | Amidation 153-156; Asn_Glycosylation 327-330, 345-348; Ck2_Phospho_Site 92-95, 124-127, 175-178, 215-218, 277-280; Myristyl 19-24, 22-27, 31-36, 288-293, 289-294, 349-354; Pkc_Phospho_Site 26-28, 277-279; | NULL |
| DEX0443_035.aa.1 | N | 0-o | 92-109, 1.185; 64-77, 1.158; 23-36, 1.141; 42-56, 1.134 | Asn_Glycosylation 60-63, 94-97; Ck2_Phospho_Site 42-45; Glycosaminoglycan 62-65, 90-93; Myristyl 112-117; Pkc_Phospho_Site 22-24; | |
| DEX0443_036.aa.1 | y | 0-o | 29-48, 1.173; 55-75, 1.114; 18-27, 1.048 | Amidation 16-19; Myristyl 7-12, 21-26, 24-29, 60-65; Pkc_Phospho_Site 64-66; | |
| DEX0443_037.aa.1 | N | 0-o | 72-89, 1.221; 16-35, 1.132; 43-63, 1.080 | Asn_Glycosylation 32-35, 59-62; Pkc_Phospho_Site 12-14; | |

-continued

| AA SEQ ID | Sig P | TMHMM | Antigenicity | PTM | Domain |
|---|---|---|---|---|---|
| DEX0443_037.aa.2 | y | 1-i22-44o | 19-46, 1.260; 140-149, 1.160; 54-73, 1.132; 5-12, 1.131; 81-101, 1.080; 161-171, 1.056; 151-157, 1.051; 123-135, 1.041 | Amidation 178-181; Asn_Glycosylation 70-73, 97-100; Ck2_Phospho_Site 7-10, 161-164; Pkc_Phospho_Site 50-52, 150-152; Tyr_Phospho_Site 152-158; | NULL |
| DEX0443_037.aa.3 | y | 1-i22-44o | 19-46, 1.260; 169-185, 1.221; 148-157, 1.160; 131-144, 1.136; 54-73, 1.132; 5-12, 1.131; 81-101, 1.080; 113-128, 1.071; 159-165, 1.051 | Asn_Glycosylation 70-73, 97-100; Ck2_Phospho_Site 7-10, 169-172; Pkc_Phospho_Site 50-52, 158-160; Tyr_Phospho_Site 160-166; | NULL |
| DEX0443_037.aa.4 | N | 0-o | 78-105, 1.202; 35-44, 1.070 | Amidation 18-21, 26-29; Myristyl 41-46, 48-53, 49-54, 55-60, 62-67, 69-74, 74-79, 83-88; Pkc_Phospho_Site 18-20, 103-105; | NULL |
| DEX0443_039.aa.2 | N | 0-o | 38-51, 1.199; 4-10, 1.169; 23-33, 1.156; 131-140, 1.101; 171-180, 1.098; 204-219, 1.095; 152-162, 1.088; 182-197, 1.081; 111-118, 1.062 | Ck2_Phospho_Site 64-67, 213-216, 225-228; Myristyl 23-28, 24-29, 27-32, 56-61, 60-65; Pkc_Phospho_Site 31-33, 37-39, 61-63, 100-102, 150-152; Tyr_Phospho_Site 151-159, 152-159; | |
| DEX0443_039.aa.3 | N | 0-o | 21-36, 1.095 | Ck2_Phospho_Site 30-33, 42-45; | |
| DEX0443_039.aa.4 | N | 0-o | 30-55, 1.226; 169-190, 1.183; 124-149, 1.183; 11-25, 1.145; 84-92, 1.128; 61-82, 1.107; 99-106, 1.075; 152-165, 1.075; 115-120, 1.042 | Asn_Glycosylation 23-26, 45-48; Ck2_Phospho_Site 31-34, 158-161, 196-199; Myristyl 80-85, 115-120, 124-129, 128-133, 173-178; Pkc_Phospho_Site 168-170; | |
| DEX0443_041.aa.8 | N | 0-o | 4-10, 1.234; 65-74, 1.192; 12-44, 1.117; 51-60, 1.101; 80-88, 1.081 | Amidation 79-82; Asn_Glycosylation 26-29; Ck2_Phospho_Site 44-47; Myristyl 13-18, 83-88; Pkc_Phospho_Site 28-30; | Rhodanese/cdc25 fold |
| DEX0443_041.aa.11 | N | 0-o | 129-138, 1.192; 24-44, 1.189; 51-62, 1.170; 4-17, 1.152; 64-71, 1.141; 86-97, 1.108; 115-124, 1.101; 144-152, 1.081; 102-108, 1.060 | Amidation 143-146; Ck2_Phospho_Site 66-69, 108-111; Myristyl 33-38, 147-152; Pkc_Phospho_Site 23-25, 59-61; | Rhodanese/cdc25 fold |

-continued

| AA SEQ ID | Sig P | TMHMM | Antigenicity | PTM | Domain |
|---|---|---|---|---|---|
| DEX0443_041.aa.12 | y | 2-<br>i12-31o239-261i | 320-332, 1.259;<br>121-140, 1.247;<br>233-260, 1.240;<br>4-39, 1.236;<br>296-317, 1.216;<br>45-55, 1.173;<br>276-285, 1.160;<br>195-204, 1.131;<br>147-154, 1.129;<br>70-77, 1.128;<br>287-294, 1.100;<br>185-192, 1.094;<br>106-112, 1.087;<br>84-93, 1.069 | Asn_Glycosylation<br>190-193;<br>Ck2_Phospho_Site<br>39-42, 87-90,<br>105-108, 123-126,<br>157-160,<br>159-162, 198-201,<br>208-211,<br>299-302;<br>Myristyl 110-115,<br>121-126,<br>163-168, 224-229,<br>242-247,<br>261-266, 294-299,<br>314-319;<br>Pkc_Phospho_Site<br>62-64; 74-76,<br>100-102, 184-186,<br>274-276,<br>321-323; | Immunoglobulin and<br>major<br>histocompatibility<br>complex domain;<br>Immunoglobulin V-<br>type; Immunoglobulin<br>C-2 type;<br>Immunoglobulin<br>subtype |
| DEX0443_041.aa.13 | y | 3-<br>i12-31o76-98i290-312o | 173-192, 1.247;<br>285-312, 1.240;<br>4-39, 1.236;<br>68-107, 1.236;<br>53-62, 1.136;<br>247-256, 1.131;<br>199-206, 1.129;<br>122-129, 1.128;<br>327-336, 1.114;<br>237-244, 1.094;<br>158-164, 1.087;<br>136-145, 1.069 | Asn_Glycosylation<br>242-245;<br>Camp_Phospho_Site<br>327-330;<br>Ck2_Phospho_Site<br>39-42, 139-142,<br>157-160, 175-178,<br>209-212,<br>211-214, 250-253,<br>260-263,<br>344-347;<br>Myristyl 54-59,<br>58-63, 162-167,<br>173-178, 215-220,<br>276-281,<br>294-299, 313-318;<br>Pkc_Phospho_Site<br>63-65, 114-116,<br>126-128, 152-154,<br>236-238,<br>326-328, 331-333,<br>332-334,<br>341-343; | Immunoglobulin and<br>major<br>histocompatibility<br>complex domain;<br>Immunoglobulin V-<br>type; Immunoglobulin<br>C-2 type;<br>Immunoglobulin<br>subtype |
| DEX0443_041.aa.14 | y | 0-o | 89-110, 1.236;<br>60-86, 1.225;<br>140-151, 1.160;<br>154-180, 1.149;<br>7-32, 1.128;<br>196-203, 1.118;<br>211-223, 1.090;<br>51-58, 1.073;<br>229-235, 1.035 | Amidation 209-212;<br>Myristyl<br>14-19, 192-197;<br>Pkc_Phospho_Site<br>37-39, 65-67;<br>Prokar_Lipoprotein<br>172-182; | |
| DEX0443_041.aa.2 | N | 0-o | 29-38, 1.192;<br>15-24, 1.101;<br>44-52, 1.081 | Amidation 43-46;<br>Ck2_Phospho_Site<br>5-8; Myristyl<br>47-52; | |
| DEX0443_041.aa.3 | N | 0-o | 35-59, 1.135;<br>83-96, 1.112;<br>15-23, 1.103;<br>66-74, 1.096 | Ck2_Phospho_Site<br>99-102; Myristyl<br>19-24, 90-95,<br>96-101;<br>Pkc_Phospho_Site<br>39-41, 44-46,<br>66-68, 75-77; | |
| DEX0443_041.aa.4 | N | 0-o | 177-186, 1.192;<br>24-44, 1.189;<br>51-62, 1.170;<br>4-17, 1.152;<br>64-71, 1.141;<br>86-97, 1.108;<br>103-126, 1.107;<br>163-172, 1.101;<br>140-156, 1.100;<br>192-200, 1.081 | Amidation 191-194;<br>Ck2_Phospho_Site<br>66-69, 118-121,<br>138-141, 156-159;<br>Myristyl<br>33-38, 145-150,<br>195-200;<br>Pkc_Phospho_Site<br>23-25, 59-61,<br>128-130; | Rhodanese/cdc25 fold |

-continued

| AA SEQ ID | Sig P | TMHMM | Antigenicity | PTM | Domain |
|---|---|---|---|---|---|
| DEX0443_041.aa.5 | N | 0-o | 156-165, 1.192; 24-44, 1.189; 51-62, 1.170; 4-17, 1.152; 64-71, 1.141; 86-97, 1.108; 142-151, 1.101; 119-135, 1.100; 171-179, 1.081 | Amidation 170-173; Ck2_Phospho_Site 66-69, 117-120, 135-138; Myristyl 33-38, 106-111, 124-129, 174-179; Pkc_Phospho_Site 23-25, 59-61; | Rhodanese/cdc25 fold |
| DEX0443_041.aa.6 | N | 0-o | 62-71, 1.192; 48-57, 1.101; 25-41, 1.100; 77-85, 1.081 | Amidation 76-79; Ck2_Phospho_Site 23-26, 41-44; Myristyl 30-35, 80-85; | Rhodanese/cdc25 fold |
| DEX0443_041.aa.7 | N | 0-o | 88-97, 1.192; 4-37, 1.107; 74-83, 1.101; 51-67, 1.100; 103-111, 1.081 | Amidation 102-105; Ck2_Phospho_Site 29-32, 49-52, 67-70; Myristyl 56-61, 106-111; Pkc_Phospho_Site 9-11, 39-41; | Rhodanese/cdc25 fold |
| DEX0443_042.aa.1 | N | 3-i13-35o50-72i100-122o | 12-42, 1.290; 49-61, 1.272; 99-129, 1.187; 79-85, 1.072; 68-74, 1.055; 87-95, 1.041 | Myristyl 65-70, 115-120; Prokar_Lipoprotein 119-129; | MIP family |
| DEX0443_042.aa.2 | Y | 2-i2-19o29-51i | 4-22, 1.290; 29-41, 1.272; 59-65, 1.072; 48-54, 1.055; 67-73, 1.035 | Myristyl 45-50; | MIP family |
| DEX0443_042.aa.3 | N | 6-i54-76o86-108i129-151o232-254i267-289o317-336i | 242-260, 1.290; 267-279, 1.272; 44-78, 1.213; 317-347, 1.187; 126-171, 1.159; 356-364, 1.149; 86-124, 1.139; 4-29, 1.106; 33-42, 1.102; 207-214, 1.098; 190-199, 1.079; 297-303, 1.072; 220-228, 1.065; 286-292, 1.055; 182-187, 1.042; 305-313, 1.041 | Asn_Glycosylation 221-224; Ck2_Phospho_Site 355-358; Myristyl 84-89, 87-92, 103-108, 108-113, 144-149, 150-155, 154-159, 225-230, 283-288, 333-338; Mip 114-122; Prokar_Lipoprotein 63-73, 337-347; | MIP family |
| DEX0443_042.aa.4 | y | 3-o79-101i114-136o164-183i | 89-107, 1.290; 114-126, 1.272; 164-194, 1.187; 4-16, 1.173; 203-211, 1.149; 31-51, 1.136; 54-61, 1.098; 144-150, 1.072; 67-75, 1.065; 133-139, 1.055; 152-160, 1.041 | Asn_Glycosylation 68-71; Ck2_Phospho_Site 202-205; Myristyl 72-77, 130-135, 180-185; Prokar_Lipoprotein 184-194; | MIP family |
| DEX0443_043.aa.1 | N | 0-o | 13-24, 1.138; 80-102, 1.114 | S100_Cabp 68-89; Asn_Glycosylation 36-39; Ck2_Phospho_Site 11-14, 13-16, 40-43, 74-77; Myristyl 91-96; Pkc_Phospho_Site 15-17, 106-108; Ef_Hand 73-85; Prokar_Lipoprotein 86-96; | S-100/ICaBP type calcium binding protein; EF-hand |

-continued

| AA SEQ ID | Sig P | TMHMM | Antigenicity | PTM | Domain |
|---|---|---|---|---|---|
| DEX0443_044.aa.1 | N | 0-o | 71-91, 1.147; 100-110, 1.136; 27-39, 1.129; 131-153, 1.127; 61-69, 1.119; 199-206, 1.110; 112-121, 1.100; 159-174, 1.094; 210-219, 1.086; 41-54, 1.068; 11-19, 1.058 | Asn_Glycosylation 14-17; Ck2_Phospho_Site 55-58, 94-97, 181-184, 200-203, 219-222; Myristyl 28-33, 146-151, 178-183; Pkc_Phospho_Site 219-221; | |
| DEX0443_044.aa.2 | N | 0-o | 169-184, 1.231; 68-83, 1.184; 200-219, 1.173; 140-159, 1.148; 28-66, 1.147; 299-319, 1.147; 5-20, 1.136; 328-338, 1.136; 255-267, 1.129; 359-381, 1.127; 289-297, 1.119; 427-434, 1.110; 221-229, 1.103; 340-349, 1.100; 190-198, 1.098; 117-126, 1.095; 387-402, 1.094; 438-447, 1.086; 269-282, 1.062; 239-247, 1.058; 101-106, 1.048 | Rnp_1 174-181; Asn_Glycosylation 96-99, 242-245; Camp_Phospho_Site 114-117; Ck2_Phospho_Site 69-72, 98-101, 126-129, 283-286, 322-325, 409-412, 428-431, 447-450; Myristyl 12-17, 21-26, 91-96, 122-127, 160-165, 256-261, 374-379, 406-411; Pkc_Phospho_Site 447-449; | RNA-binding region RNP-1 (RNA recognition motif); Aminopeptidase N, APN (CD13) |
| DEX0443_044.aa.3 | N | 0-o | 85-100, 1.231; 116-135, 1.173; 62-75, 1.153; 215-235, 1.147; 244-254, 1.136; 6-32, 1.130; 171-183, 1.129; 275-297, 1.127; 205-213, 1.119; 343-350, 1.110; 137-145, 1.103; 256-265, 1.100; 106-114, 1.098; 303-318, 1.094; 37-54, 1.090; 354-363, 1.086; 185-198, 1.062; 155-163, 1.058 | Rnp_1 90-97; Asn_Glycosylation 158-161; Ck2_Phospho_Site 199-202, 238-241, 325-328, 344-347, 363-366; Myristyl 71-76, 76-81, 172-177, 290-295, 322-327; Pkc_Phospho_Site 20-22, 27-29, 363-365; | RNA-binding region RNP-1 (RNA recognition motif) |
| DEX0443_044.aa.4 | N | 0-o | 355-370, 1.231; 155-177, 1.222; 416-488, 1.204; 40-53, 1.194; 96-144, 1.189; 254-269, 1.184; 506-525, 1.173; 326-345, 1.148; 225-252, 1.147; 605-625, 1.147; 189-219, 1.145; 57-80, 1.139; 634-644, 1.136; 376-406, 1.135; 561-573, 1.129; 4-36, 1.128; 665-687, 1.127; 595-603, 1.119; 733-740, 1.110; 527-535, 1.103; 646-655, 1.100; | Rnp_1 360-367; Asn_Glycosylation 118-121, 282-285, 548-551; Camp_Phospho_Site 300-303; Ck2_Phospho_Site 86-89, 216-219, 255-258, 284-287, 312-315, 589-592, 628-631, 715-718, 734-737, 753-756; Myristyl 5-10, 43-48, 62-67, 277-282, 308-313, 346-351, 411-416, 415-420, 473-478, 562-567, 680-685, 712-717; | RNA-binding region RNP-I (RNA recognition motif); Proline-rich region; Aminopeptidase N, APN (CD13) |

-continued

| AA SEQ ID | Sig P | TMHMM | Antigenicity | PTM | Domain |
|---|---|---|---|---|---|
| | | | 303-312, 1.095; 693-708, 1.094; 491-504, 1.094; 744-753, 1.086; 575-588, 1.062; 545-553, 1.058; 287-292, 1.048 | Pkc_Phospho_Site 204-206, 416-418, 753-755; | |
| DEX0443_045.aa.1 | N | 0-o | 15-27, 1.138 | | |
| DEX0443_046.aa.2 | N | 0-o | 155-180, 1.130; 19-35, 1.124; 101-118, 1.114; 129-153, 1.114; 42-55, 1.112; 192-217, 1.110; 80-88, 1.109; 90-98, 1.086; 182-190, 1.072; 73-78, 1.051; 64-70, 1.042 | Asp_Protease 118-129; Ck2_Phospho_Site 11-14, 61-64, 180-183, 220-223; Myristyl 65-70, 169-174, 187-192, 230-235; Pkc_Phospho_Site 131-133; Crystallin_Betagamma 73-88; | Crystallin; Pepsin (A1) aspartic protease; Eukaryotic and viral aspartic protease active site |
| DEX0443_047.aa.2 | N | 0-i | 8-26, 1.184 | Amidation 36-39; Asn_Glycosylation 32-35; Camp_Phospho_Site 38-41; Pkc_Phospho_Site 31-33, 34-36, 41-43; | |
| DEX0443_049.aa.1 | N | 0-o | 72-88, 1.205; 143-151, 1.196; 29-64, 1.191; 224-270, 1.182; 101-129, 1.143; 159-167, 1.132; 4-14, 1.131; 302-314, 1.094; 90-96, 1.092; 189-195, 1.087; 171-178, 1.080; 280-285, 1.067; 317-331, 1.060; 338-344, 1.040; 201-206, 1.036; 214-219, 1.034 | Tnfr_Ngfr_1 26-63, 66-107; Asn_Glycosylation 23-26, 160-163; Camp_Phospho_Site 102-105; Ck2_Phospho_Site 25-28, 65-68, 70-73, 123-126, 135-138, 172-175, 270-273; Myristyl 3-8, 48-53, 112-117, 146-151, 178-183, 185-190, 294-299, 299-304; Pkc_Phospho_Site 25-27, 52-54, 100-102, 101-103, 192-194; Tyr_Phospho_Site 27-33; | Proline-rich region; TNFR/CD27/30/40/95 cysteine-rich region; NULL |
| DEX0443_049.aa.2 | Y | 0-o | 94-110, 1.205; 165-173, 1.196; 51-86, 1.191; 246-292, 1.182; 123-151, 1.170; 9-36, 1.166; 182-189, 1.113; 324-336, 1.094; 112-118, 1.092; 211-217, 1.087; 193-200, 1.080; 302-307, 1.067; 378-385, 1.063; 339-353, 1.060; 360-366, 1.040; 223-228, 1.036; 236-241, 1.034 | Tnfr_Ngfr_1 48-85, 88-129; Asn_Glycosylation 45-48, 182-185; Camp_Phospho_Site 124-127; Ck2_Phospho_Site 47-50, 87-90, 92-95, 145-148, 157-160, 194-197, 292-295; Myristyl 28-33, 70-75, 134-139, 168-173, 200-205, 207-212, 316-321, 321-326, 388-393; Pkc_Phospho_Site 47-49, 74-76, 122-124, 123-125, 187-189, 214-216, 392-394; Tyr_Phospho_Site 49-55; | Proline-rich region; TNFR/CD27/30/40/95 cysteine-rich region; NULL |

-continued

| AA SEQ ID | Sig P | TMHMM | Antigenicity | PTM | Domain |
|---|---|---|---|---|---|
| DEX0443_049.aa.3 | y | 1-<br>o226-248i | 227-264, 1.216;<br>94-110, 1.205;<br>165-173, 1.196;<br>51-86, 1.191;<br>282-328, 1.182;<br>123-151, 1.170;<br>9-36, 1.166;<br>182-189, 1.113;<br>360-372, 1.094;<br>112-118, 1.092;<br>211-217, 1.087;<br>193-200, 1.080;<br>338-343, 1.067;<br>414-421, 1.063;<br>375-389, 1.060;<br>396-402, 1.040;<br>272-277, 1.034 | Tnfr_Ngfr_1 48-85,<br>88-129;<br>Asn_Glycosylation<br>45-48, 182-185;<br>Camp_Phospho_Site<br>124-127;<br>Ck2_Phospho_Site<br>47-50, 87-90,<br>92-95, 145-148,<br>157-160, 194-197,<br>328-331;<br>Myristyl 28-33,<br>70-75, 134-139,<br>168-173, 200-205,<br>207-212,<br>352-357, 357-362,<br>424-429;<br>Pkc_Phospho_Site<br>47-49, 74-76,<br>122-124, 123-125,<br>187-189,<br>214-216, 428-430;<br>Tyr_Phospho_Site<br>49-55;<br>Prokar_Lipoprotein<br>241-251; | Proline-rich region;<br>TNFR/CD27/30/40/95<br>cysteine-rich<br>region; NULL |
| DEX0443_049.aa.4 | y | 1-<br>o226-248i | 227-264, 1.216;<br>94-110, 1.205;<br>424-442, 1.202;<br>165-173, 1.196;<br>51-86, 1.191;<br>282-328, 1.182;<br>123-151, 1.170;<br>9-36, 1.166;<br>182-189, 1.113;<br>360-372, 1.094;<br>112-118, 1.092;<br>211-217, 1.087;<br>193-200, 1.080;<br>338-343, 1.067;<br>414-421, 1.063;<br>375-389, 1.060;<br>396-402, 1.040;<br>272-277, 1.034 | Tnfr_Ngfr_1 48-85,<br>88-129;<br>Asn_Glycosylation<br>45-48, 182-185;<br>Camp_Phospho_Site<br>124-127;<br>Ck2_Phospho_Site<br>47-50, 87-90,<br>92-95, 145-148,<br>157-160, 194-197,<br>328-331,<br>448-451, 450-453;<br>Myristyl<br>28-33, 70-75,<br>134-139, 168-173,<br>200-205,<br>207-212, 352-357,<br>357-362,<br>424-429;<br>Pkc_Phospho_Site<br>47-49, 74-76,<br>122-124, 123-125,<br>187-189,<br>214-216;<br>Tyr_Phospho_Site<br>49-55;<br>Prokar_Lipoprotein<br>241-251; | Proline-rich region;<br>TNFR/CD27/30/40/95<br>cysteine-rich<br>region; NULL |
| DEX0443_049.aa.5 | y | 1-<br>o426-448i | 344-423, 1.224;<br>427-464, 1.216;<br>94-110, 1.205;<br>165-173, 1.196;<br>296-325, 1.193;<br>51-86, 1.191;<br>482-528, 1.182;<br>268-294, 1.175;<br>123-151, 1.170;<br>9-36, 1.166;<br>224-241, 1.144;<br>247-265, 1.134;<br>182-189, 1.113;<br>560-572, 1.094;<br>112-118, 1.092;<br>211-217, 1.087;<br>193-200, 1.080;<br>538-543, 1.067;<br>614-621, 1.063;<br>575-589, 1.060;<br>596-602, 1.040; | Tnfr_Ngfr_1 48-85,<br>88-129;<br>Amidation 387-390;<br>Asn_Glycosylation<br>45-48, 182-185;<br>Camp_Phospho_Site<br>124-127;<br>Ck2_Phospho_Site<br>47-50, 87-90,<br>92-95, 145-148,<br>157-160, 194-197,<br>528-531;<br>Myristyl 28-33,<br>70-75, 134-139,<br>168-173, 200-205,<br>207-212,<br>248-253, 291-296,<br>381-386,<br>401-406, 416-421,<br>552-557,<br>557-562, 624-629; | Proline-rich region;<br>TNFR/CD27/30/40/95<br>cysteine-rich<br>region; NULL |

-continued

| AA SEQ ID | Sig P | TMHMM | Antigenicity | PTM | Domain |
|---|---|---|---|---|---|
| | | | 472-477, 1.034 | Pkc_Phospho_Site 47-49, 74-76, 122-124, 123-125, 187-189, 214-216, 326-328, 336-338, 628-630; Tyr_Phospho_Site 49-55; Prokar_Lipoprotein 441-451; | |
| DEX0443_049.aa.6 | y | 0-o | 13-25, 1.182; 41-87, 1.182; 119-131, 1.094; 97-102, 1.067; 173-180, 1.063; 134-148, 1.060; 155-161, 1.040; 31-36, 1.034 | Camp_Phospho_Site 14-17; Ck2_Phospho_Site 87-90; Myristyl 111-116, 116-121, 183-188; Pkc_Phospho_Site 187-189; | Proline-rich region |
| DEX0443_049.aa.7 | y | 1-o226-248i | 227-265, 1.216; 94-110, 1.205; 165-173, 1.196; 51-86, 1.191; 123-151, 1.170; 9-36, 1.166; 182-189, 1.113; 112-118, 1.092; 211-217, 1.087; 193-200, 1.080 | Tnfr_Ngfr_1 48-85, 88-129; Asn_Glycosylation 45-48, 182-185; Camp_Phospho_Site 124-127; Ck2_Phospho_Site 47-50, 87-90, 92-95, 145-148, 157-160, 194-197, 293-296; Myristyl 28-33, 70-75, 134-139, 168-173, 200-205, 207-212, 276-281, 289-294; Pkc_Phospho_Site 47-49, 74-76, 122-124, 123-125, 187-189, 214-216; Rgd 285-287; Tyr_Phospho_Site 49-55; Prokar_Lipoprotein 241-251; | TNFR/CD27/30/40/95 cysteine-rich region; NULL |
| DEX0443_051.aa.3 | N | 1-o1076-1098i | 75-97, 1.213; 511-523, 1.208; 101-127, 1.205; 300-322, 1.204; 830-853, 1.199; 669-688, 1.196; 785-803, 1.189; 1067-1094, 1.185; 391-399, 1.184; 327-340, 1.179; 1105-1124, 1.175; 50-63, 1.170; 757-776, 1.166; 732-749, 1.164; 183-214, 1.156; 601-609, 1.153; 159-167, 1.149; 696-708, 1.147; 257-270, 1.146; 556-567, 1.145; 488-500, 1.135; 878-885, 1.134; 624-642, 1.127; 897-912, 1.125; 1024-1031, 1.115; 811-828, 1.115; 441-455, 1.113; 865-875, 1.108; 292-298, 1.101; | Asn_Glycosylation 689-692, 754-757; Ck2_Phospho_Site 9-12, 12-15, 42-45, 206-209, 303-306, 378-381, 392-395, 480-483, 624-627, 722-725, 784-787, 810-813, 934-937; Myristyl 232-237, 431-436, 503-508, 620-625, 758-763, 921-926, 944-949; Pkc_Phospho_Site 68-70, 224-226, 243-245, 347-349, 409-411, 435-437, 472-474, 572-574, 732-734, 997-999; Tyr_Phospho_Site 702-709; His_Acid_Phosphat_1 396-410; | Histidine acid phosphatase |

-continued

| AA SEQ ID | Sig P | TMHMM | Antigenicity | PTM | Domain |
|---|---|---|---|---|---|
| | | | 470-480, 1.099; 584-599, 1.097; 362-370, 1.093; 1046-1054, 1.091; 377-384, 1.090; 138-143, 1.090; 1096-1102, 1.088; 942-948, 1.087; 1015-1022, 1.080; 346-352, 1.078; 14-19, 1.077; 413-423, 1.077; 569-576, 1.075; 229-238, 1.074; 541-547, 1.070; 919-925, 1.063; 275-281, 1.062; 984-990, 1.061; 998-1004, 1.059; 970-976, 1.055; 650-656, 1.047; 1034-1041, 1.034; 658-665, 1.032 | | |
| DEX0443_051.aa.4 | Y | 0-o | 28-41, 1.179; 4-23, 1.161; 47-52, 1.078 | Pkc_Phospho_Site 48-50; | |
| DEX0443_051.aa.5 | N | 0-o | 40-69, 1.205; 6-12, 1.070; 15-38, 1.069 | Ck2_Phospho_Site 5-8; Myristyl 54-59; Prokar_Lipoprotein 59-69; | |
| DEX0443_054.aa.1 | N | 0-o | 41-70, 1.189; 4-17, 1.152; 19-32, 1.139 | Ck2_Phospho_Site 21-24, 61-64, 75-78; Myristyl 88-93; Pkc_Phospho_Site 54-56; | Ligand-binding domain of nuclear hormone receptor |
| DEX0443_055.aa.2 | N | 0-o | 206-216, 1.161; 224-270, 1.139; 134-141, 1.105; 155-161, 1.069; 170-176, 1.057; 189-197, 1.056; 181-187, 1.046 | Camp_Phospho_Site 27-30, 43-46, 56-59, 96-99; Ck2_Phospho_Site 71-74, 82-85, 98-101, 99-102; Pkc_Phospho_Site 14-16, 22-24, 51-53, 71-73, 95-97, 135-137, 235-237; | NULL |
| DEX0443_055.aa.3 | N | 0-o | 45-57, 1.088; 131-139, 1.087; 31-38, 1.077; 82-99, 1.054; 19-25, 1.048; 121-127, 1.043 | Asn_Glycosylation 20-23, 30-33; Ck2_Phospho_Site 32-35, 65-68; Pkc_Phospho_Site 22-24, 32-34, 48-50, 142-144; | NULL |
| DEX0443_057.aa.2 | N | 0-o | 53-85, 1.167; 23-46, 1.136; 13-21, 1.113 | Amidation 14-17 Pkc_Phospho_Site 3-5, 98-100; | |
| DEX0443_057.aa.3 | N | 0-o | 16-29, 1.174; 4-14, 1.170; 54-62, 1.151; 37-43, 1.094; 69-74, 1.058 | Myristyl 34-39, 56-61, 57-62; Pkc_Phospho_Site 28-30; Rgd 69-71; Prokar_Lipoprotein 19-29, 54-64; | |
| DEX0443_057.aa.4 | N | 0-o | 143-153, 1.228; 53-85, 1.167; 111-141, 1.157; 23-46, 1.136; 13-21, 1.113; 94-109, 1.111 | Amidation 14-17; Myristyl 150-155; Pkc_Phospho_Site 3-5, 98-100, 125-127; | |

-continued

| AA SEQ ID | Sig P | TMHMM | Antigenicity | PTM | Domain |
|---|---|---|---|---|---|
| DEX0443_058.aa.1 | N | 0-o | 61-84, 1.209; 28-40, 1.130; 10-19, 1.130; 97-116, 1.105; 49-55, 1.060 | Camp_Phospho_Site 51-54; Ck2_Phospho_Site 13-16; Pkc_Phospho_Site 41-43, 56-58, 62-64; Tyr_Phospho_Site 5-12; | Ribosomal protein L1 |
| DEX0443_058.aa.2 | N | 0-o | 30-42, 1.130; 11-20, 1.130; 51-56, 1.091 | Camp_Phospho_Site 53-56; Ck2_Phospho_Site 14-17; Pkc_Phospho_Site 3-5, 43-45, 58-60; Tyr_Phospho_Site 7-14; | |
| DEXO443_058.aa.3 | N | 0-i | 4-50, 1.172; 60-75, 1.115; 81-89, 1.094 | Myristyl 43-48; Pkc_Phospho_Site 28-30, 71-73; | |
| DEXO443_058.aa.4 | N | 0-o | 6-19, 1.134; 42-49, 1.111; 22-32, 1.100 | Ck2_Phospho_Site 23-26; | |
| DEXO443_059.aa.2 | N | 0-o | 66-78, 1.231; 115-126, 1.181; 152-171, 1.170; 4-29, 1.161; 328-335, 1.156; 380-399, 1.130; 52-62, 1.129; 342-355, 1.121; 181-194, 1.117; 99-112, 1.116; 133-150, 1.101; 304-320, 1.087 | Atp_Gtp_A 223-230; Asn_Glycosylation 257-260, 268-271; Ck2_Phospho_Site 63-66, 93-96, 101-104, 113-116, 118-121, 177-180, 192-195, 247-250, 273-276, 293-296, 320-323, 375-378; Myristyl 28-33, 52-57, 106-111, 149-154, 182-187, 265-270, 302-307, 361-366; Pkc_Phospho_Site 32-34, 233-235, 244-246, 270-272, 375-377; | Proline-rich region; ATP/GTP-binding site motif A (P-loop) |
| DEXO443_059.aa.3 | y | 0-o | 201-235, 1.223; 128-141, 1.209; 5-21, 1.185; 155-171, 1.175; 33-54, 1.174; 82-95, 1.153; 60-66, 1.125; 106-119, 1.097; 181-194, 1.090; 74-79, 1.060 | Camp_Phospho_Site 37-40; Ck2_Phospho_Site 101-104; Myristyl 127-132; Pkc_Phospho_Site 35-37, 52-54, 70-72, 183-185; Tyr_Phospho_Site 116-123; Polyprenyl_Synthet_1 172-186; | Polyprenyl synthetase |
| DEX0443_060.aa.2 | N | 0-o | 175-185, 1.225; 124-165, 1.203; 362-370, 1.179; 25-49, 1.169; 280-315, 1.154; 73-90, 1.133; 9-15, 1.130; 111-121, 1.127; 323-341, 1.121; 95-102, 1.121; 253-265, 1.112; 201-211, 1.092; 55-61, 1.085; 350-357, 1.074; 243-250, 1.061; 269-278, 1.061 | Asn_Glycosylation 56-59, 349-352; Ck2_Phospho_Site 123-126, 174-177, 233-236, 235-238, 313-316, 323-326, 357-360; Myristyl 60-65, 229-234, 362-367; Pkc_Phospho_Site 73-75, 76-78, 301-303, 354-356, 363-365; Tyr_Phospho_Site 303-309; | |

-continued

| AA SEQ ID | Sig P | TMHMM | Antigenicity | PTM | Domain |
|---|---|---|---|---|---|
| DEX0443_060.aa.3 | N | 0-o | 175-185, 1.225; 124-165, 1.203; 473-482, 1.179; 25-49, 1.169; 578-589, 1.155; 280-315, 1.154; 394-416, 1.152; 368-384, 1.143; 424-465, 1.143; 489-499, 1.139; 73-90, 1.133; 9-15, 1.130; 111-121, 1.127; 323-355, 1.122; 95-102, 1.121; 521-528, 1.118; 253-265, 1.112; 539-548, 1.107; 601-618, 1.106; 201-211, 1.092; 623-630, 1.089; 55-61, 1.085; 655-665, 1.082; 386-392, 1.069; 557-564, 1.066; 243-250, 1.061; 269-278, 1.061; 507-513, 1.056; 633-639, 1.052; 360-365, 1.048 | Asn_Glycosylation 56-59; Ck2_Phospho_Site 123-126, 174-177, 233-236, 235-238, 313-316, 323-326, 545-548, 645-648, 658-661; Leucine_Zipper 458-479; Myristyl 60-65, 229-234, 354-359, 366-371, 512-517; Pkc_Phospho_Site 73-75, 76-78, 301-303, 518-520, 531-533, 560-562, 593-595, 636-638, 637-639, 657-659; Tyr_Phospho_Site 303-309; | |
| DEX0443_060.aa.6 | N | 0-o | 4-25, 1.169; 100-114, 1.165; 49-66, 1.133; 87-97, 1.127; 71-78, 1.121; 31-37, 1.085 | Asn_Glycosylation 32-35; Ck2_Phospho_Site 99-102; Myristyl 36-41; Pkc_Phospho_Site 49-51, 52-54; | |
| DEX0443_060.aa.7 | N | 0-i | 54-64, 1.148; 42-50, 1.103; 69-82, 1.079; 28-33, 1.073 | Amidation 29-32; Camp_Phospho_Site 42-45; Myristyl 33-38, 83-88; Pkc_Phospho_Site 56-58, 68-70, 78-80; | |
| DEX0443_061.aa.2 | N | 0-o | 4-16, 1.105; 24-38, 1.103; 41-50, 1.071 | Glycosaminoglycan 59-62; Pkc_Phospho_Site 3-5, 53-55, 59-61; | |
| DEX0443_062.aa.1 | N | 0-o | 41-51, 1.181; 148-157, 1.148; 173-180, 1.141; 58-74, 1.121; 22-38, 1.115; 4-19, 1.099; 77-88, 1.088; 103-115, 1.072; 117-129, 1.064; 92-101, 1.058 | Ubiquitin_1 34-59; Amidation 185-188; Camp_Phospho_Site 162-165; Ck2_Phospho_Site 25-28, 72-75; Glycosaminoglycan 107-110; Pkc_Phospho_Site 99-101, 118-120, 165-167; | Ubiquitin domain |
| DEX0443_062.aa.2 | N | 0-o | 52-59, 1.141; 12-20, 1.088; 24-32, 1.042 | Amidation 64-67; Camp_Phospho_Site 41-44; Pkc_Phospho_Site 31-33, 44-46; | |
| DEX0443_064.aa.1 | Y | 1-o252-274i | 251-283, 1.275; 216-228, 1.194; 180-192, 1.149; 61-71, 1.145; 6-32, 1.142; 96-114, 1.119; 172-178, 1.104; 142-160, 1.096; | Tissue_Factor 82-99; Amidation 200-203; Asn_Glycosylation 48-51, 161-164, 174-177; Camp_Phospho_Site 237-240; | Cytokine receptor class 2 family; Tissue Factor (TF) |

-continued

| AA SEQ ID | Sig P | TMHMM | Antigenicity | PTM | Domain |
|---|---|---|---|---|---|
| | | | 38-43, 1.087; 236-242, 1.071; 79-84, 1.064; 88-94, 1.049 | Ck2_Phospho_Site 58-61, 90-93, 92-95, 125-128, 163-166, 179-182, 242-245, 290-293; Myristyl 36-41, 39-44, 118-123, 157-162, 248-253, 286-291; Pkc_Phospho_Site 50-52, 76-78, 179-181, 200-202, 204-206, 290-292; | |
| DEX0443_066.aa.1 | N | 0-o | 9-21, 1.183; 162-173, 1.135; 135-147, 1.124; 333-358, 1.121; 307-315, 1.097; 68-80, 1.085; 196-208, 1.074; 82-104, 1.070; 319-325, 1.056 | | RNA-binding protein C2H2 Zn-finger domain; WW/rsp5/ WWP domain; U1-like zinc finger |
| DEX0443_066.aa.2 | N | 0-o | 356-398, 1.245; 423-436, 1.239; 26-43, 1.189; 131-145, 1.184; 589-599, 1.174; 45-56, 1.173; 210-228, 1.167; 492-538, 1.161; 438-455, 1.150; 540-559, 1.135; 237-249, 1.127; 82-90, 1.126; 282-289, 1.113; 465-474, 1.113; 4-17, 1.107; 328-338, 1.106; 268-280, 1.098; 340-347, 1.087; 412-421, 1.071; 481-489, 1.069; 63-71, 1.063; 312-318, 1.061; 153-159, 1.060; 603-608, 1.050 | Amidation 181-184; Asn_Glycosylation 198-201, 329-332, 417-420, 522-525; Camp_Phospho_Site 576-579; Ck2_Phospho_Site 69-72, 93-96, 131-134, 132-135, 172-175, 236-239, 311-314, 410-413; Myristyl 341-346, 344-349, 353-358, 497-502, 555-560; Pkc_Phospho_Site 200-202, 236-238, 326-328, 331-333, 422-424, 437-439, 468-470, 493-495, 543-545, 587-589; Tyr_Phospho_Site 259-266; Ets_Domain_1 215-223; Ets_Domain_2 261-276; | Ets-domain; HSF/ETS DNA-binding domain; NULL |
| DEX0443_067.aa.1 | N | 0-o | 4-11, 1.149; 45-54, 1.095; 29-34, 1.048 | Asn_Glycosylation 24-27; Camp_Phospho_Site 42-45; Ck2_Phospho_Site 26-29, 54-57; Myristyl 19-24, 50-55; | Aminopeptidase N, APN (CD13) |
| DEX0443_071.aa.1 | N | 0-o | 41-51, 1.181; 148-157, 1.148; 173-180, 1.141; 58-74, 1.121; 22-38, 1.115; 4-19, 1.099; 77-88, 1.088; 103-115, 1.072; 117-129, 1.064; 92-101, 1.058 | Ubiquitin_1 34-59; Amidation 185-188; Camp_Phospho_Site 162-165; Ck2_Phospho_Site 25-28, 72-75; Glycosaminoglycan 107-110; Pkc_Phospho_Site 99-101, 118-120, 165-167; | Ubiquitin domain |

-continued

| AA SEQ ID | Sig P | TMHMM | Antigenicity | PTM | Domain |
|---|---|---|---|---|---|
| DEX0443_075.aa.1 | N | 0-o | 23-35, 1.178; 213-239, 1.178; 140-168, 1.155; 241-249, 1.130; 290-299, 1.123; 195-211, 1.089; 279-285, 1.080; 57-71, 1.076; 100-106, 1.070; 170-176, 1.068; 79-89, 1.060; 8-15, 1.052; 261-266, 1.025 | Asn_Glycosylation 19-22, 46-49, 137-140; Ck2_Phospho_Site 77-80, 139-142, 239-242, 243-246; Myristyl 15-20, 44-49, 68-73, 92-97, 97-102, 101-106, 115-120, 233-238; Pkc_Phospho_Site 74-76, 77-79, 119-121, 188-190, 212-214, 274-276, 303-305; | Lipocalin-related protein and Bos/Can/Equallergen; Lipocalin |
| DEX0443_076.aa.1 | N | 0-i | 21-29, 1.168; 63-80, 1.159; 103-111, 1.144; 82-96, 1.123; 148-157, 1.113; 54-60, 1.086; 135-143, 1.070; 125-133, 1.062 | Amidation 9-12; Camp_Phospho_Site 13-16; Ck2_Phospho_Site 149-152; Myristyl 79-84, 88-93; Pkc_Phospho_Site 20-22, 59-61, 67-69, 74-76, 149-151; Ribosomal_L21e 43-68; | Ribosomal protein L21E |
| DEX0443_077.aa.1 | N | 0-o | 72-88, 1.205; 143-151, 1.196; 29-64, 1.191; 224-270, 1.182; 101-129, 1.143; 159-167, 1.132; 4-14, 1.131; 302-314, 1.094; 90-96, 1.092; 189-195, 1.087; 171-178, 1.080; 280-285, 1.067; 317-331, 1.060; 338-344, 1.040; 201-206, 1.036; 214-219, 1.034 | Tnfr_Ngfr_1 26-63, 66-107; Asn_Glycosylation 23-26, 160-163; Camp_Phospho_Site 102-105; Ck2_Phospho_Site 25-28, 65-68, 70-73, 123-126, 135-138, 172-175, 270-273; Myristyl 3-8, 48-53, 112-117, 146-151, 178-183, 185-190, 294-299, 299-304; Pkc_Phospho_Site 25-27, 52-54, 100-102, 101-103, 192-194; Tyr_Phospho_Site 27-33; | Proline-rich region; TNFR/CD27/30/40/95 cysteine-rich region; NULL |
| DEX0443_081.aa.1 | N | 0-o | 13-24, 1.138; 80-102, 1.114 | S100_Cabp 68-89; Asn_Glycosylation 36-39; Ck2_Phospho_Site 11-14, 13-16, 40-43, 74-77; Myristyl 91-96; Pkc_Phospho_Site 15-17, 106-108; Ef_Hand 73-85; Prokar_Lipoprotein 86-96; | S-100/ICaBP type calcium binding protein; EF-hand |
| DEX0443_093.aa.1 | N | 0-o | 50-67, 1.164; 35-48, 1.140; 4-12, 1.093; 16-22, 1.087 | Ck2_Phospho_Site 15-18; | |

-continued

| AA SEQ ID | Sig P | TMHMM | Antigenicity | PTM | Domain |
| --- | --- | --- | --- | --- | --- |
| DEX0443_094.aa.1 | N | 0-o | 71-83, 1.182; 90-97, 1.134; 211-219, 1.127; 130-141, 1.117; 186-193, 1.076; 59-65, 1.067; 195-202, 1.065; 226-240, 1.059; 169-177, 1.041 | Asn_Glycosylation 13-16, 40-43; Ck2_Phospho_Site 119-122, 125-128, 149-152, 162-165, 214-217, 225-228; Myristyl 134-139; Pkc_Phospho_Site 105-107, 173-175; Rgd 93-95; Tyr_Phospho_Site 109-115; | Osteopontin; NULL |
| DEX0443_095.aa.1 | Y | 0-o | 351-360, 1.285; 4-15, 1.269; 101-117, 1.189; 150-164, 1.148; 300-310, 1.144; 264-294, 1.134; 19-35, 1.134; 184-200, 1.124; 332-340, 1.123; 207-220, 1.112; 245-253, 1.109; 312-319, 1.085; 67-73, 1.074; 119-138, 1.065; 90-96, 1.060; 238-243, 1.051; 38-45, 1.048; 229-235, 1.042; 174-179, 1.036 | Asp_Protease 98-109; Asn_Glycosylation 95-98; Ck2_Phospho_Site 70-73, 173-176, 180-183, 226-229, 302-305, 331-334, 345-348, 353-356; Myristyl 137-142, 147-152, 151-156, 167-172, 230-235; Pkc_Phospho_Site 36-38, 70-72, 277-279, 353-355, 365-367; Crystallin_Betagamma 238-253; Prokar_Lipoprotein 268-278; | Crystallin; Pepsin (A1) aspartic protease; Eukaryotic and viral aspartic protease active site |
| DEX0443_097.aa.1 | N | 0-o | 140-148, 1.140; 4-21, 1.126; 52-70, 1.119; 37-46, 1.108; 74-87, 1.101; 111-121, 1.089; 100-107, 1.088; 93-98, 1.082; 123-132, 1.074 | Amidation 140-143; Asn_Glycosylation 34-37, 95-98; Ck2_Phospho_Site 64-67; Glycosaminoglycan 53-56; Myristyl 44-49, 98-103, 137-142; Pkc_Phospho_Site 74-76, 133-135; | |
| DEX0443_100.aa.1 | N | 0-o | 51-60, 1.178; 62-68, 1.130; 30-45, 1.109 | Asn_Glycosylation 19-22; Ck2_Phospho_Site 60-63, 64-67; Myristyl 17-22, 41-46, 54-59; Pkc_Phospho_Site 47-49; | Lipocalin-related protein and Bos/Can/Equ allergen |
| DEX0443_102.aa.1 | N | 1-o15-37i | 163-194, 1.164; 148-161, 1.149; 97-111, 1.142; 69-86, 1.136; 129-145, 1.136; 34-54, 1.104; 13-26, 1.100 | Ck2_Phospho_Site 87-90, 116-119, 148-151; Myristyl 142-147, 191-196; Pkc_Phospho_Site 45-47; | Binding-protein-dependent transport systems inner membrane component; MAPEG (Membrane-associated proteins in eicosanoid and glutathione metabolism); NULL |
| DEX0443_102.aa.2 | N | 0-i | 9-21, 1.314; 25-39, 1.158 | Ck2_Phospho_Site 40-43; Pkc_Phospho_Site 3-5; | |
| DEX0443_109.aa.1 | N | 0-o | 15-27, 1.138 | | |

Altogether, splice variant sequence analysis, EST support, SAGE tag data, and protein annotation are indicative of SEQ ID NO: 1-248 and encoded protein SEQ ID NO: 249-396 being a diagnostic marker and/or a therapeutic target for cancer.

Example 3b

RT-PCR Analysis

To detect the presence and tissue distribution of a particular splice variant Reverse Transcription-Polymerase Chain Reaction (RT-PCR) is performed using cDNA generated from a panel of tissue RNAs. See, e.g., Sambrook et al., *Molecular Cloning: A Laboratory Manual.* 2d ed., Cold Spring Harbor Laboratory Press (1989) and; Kawasaki E S et al., *PNAS* 85(15):5698 (1988). Total RNA is extracted from a variety of tissues and first strand cDNA is prepared with reverse transcriptase (RT). Each panel includes 23 cDNAs from five cancer types (lung, ovary, breast, colon, and prostate) and normal samples of testis, placenta and fetal brain. Each cancer set is composed of three cancer cDNAs from different donors and one normal pooled sample. Using a standard enzyme kit from BD Bioscience Clontech (Mountain View, Calif.), the target transcript is detected with sequence-specific primers designed to only amplify the particular splice variant. The PCR reaction is run on the Gene-Amp PCR system 9700 (Applied Biosystem, Foster City, Calif.) thermocycler under optimal conditions. One of ordinary skill can design appropriate primers and determine optimal conditions. The amplified product is resolved on an agarose gel to detect a band of equivalent size to the predicted RT-PCR product. A band indicated the presence of the splice variant in a sample. The relation of the amplified product to the splice variant was subsequently confirmed by DNA sequencing.

After subcloning, all positively screened clones are sequence verified. The DNA sequence verification results show the splice variant contains the predicted sequence differences in comparison with the reference sequence.

RT-PCR results confirm the presence SEQ ID NO: 1-248 in biologic samples and distinguish between related transcripts.

Example 3c

Secretion Assay

To determine if a protein encoded by a splice variant is secreted from cells a secretion assay is preformed. A pcDNA3.1 clone containing the gene transcript which encodes the variant protein is transfected into 293T cells using the Superfect transfection reagent (Qiagen, Valencia Calif.). Transfected cells are incubated for 28 hours before the media is collected and immediately spun down to remove any detached cells. The adherent cells are solubilized with lysis buffer (1% NP40, 10 nM sodium phosphate pH7.0, and 0.15M NaCl). The lysed cells are collected and spun down and the supernatant extracted as cell lysate. Western immunoblot is carried out in the following manner: 15 µl of the cell lysate and media are run on 4-12% NuPage Bis-Tris gel (Invitrogen, Carlsbad Calif.), and blotted onto a PVDF membrane (Invitrogen, Carlsbad Calif.). The blot is incubated with a polyclonal primary antibody which binds to the variant protein (Imgenex, San Diego Calif.) and polyclonal goat anti-rabbit-peroxidase secondary antibody (Sigma-Aldrich, St. Louis Mo.). The blot is developed with the ECL Plus chemiluminescent detection reagent (Amersham BioSciences, Piscataway N.J.).

Secretion assay results are indicative of SEQ ID NO: 249-396 being a diagnostic marker and/or therapeutic target for cancer.

Example 2

Relative Quantitation of Gene Expression

Real-Time quantitative PCR with fluorescent Taqman® probes is a quantitation detection system utilizing the 5'-3' nuclease activity of Taq DNA polymerase. The method uses an internal fluorescent oligonucleotide probe (Taqman®) labeled with a 5' reporter dye and a downstream, 3' quencher dye. During PCR, the 5'-3' nuclease activity of Taq DNA polymerase releases the reporter, whose fluorescence can then be detected by the laser detector of the Model 7700 Sequence Detection System (PE Applied Biosystems, Foster City, Calif., USA). Amplification of an endogenous control is used to standardize the amount of sample RNA added to the reaction and normalize for Reverse Transcriptase (RT) efficiency. Either cyclophilin, glyceraldehyde-3-phosphate dehydrogenase (GAPDH), ATPase, or 18S ribosomal RNA (rRNA) is used as this endogenous control. To calculate relative quantitation between all the samples studied, the target RNA levels for one sample were used as the basis for comparative results (calibrator). Quantitation relative to the "calibrator" can be obtained using the comparative method (User Bulletin #2: ABI PRISM 7700 Sequence Detection System).

The tissue distribution and the level of the target gene are evaluated for every sample in normal and cancer tissues. Total RNA is extracted from normal tissues, cancer tissues, and from cancers and the corresponding matched adjacent tissues. Subsequently, first strand cDNA is prepared with reverse transcriptase and the polymerase chain reaction is done using primers and Taqman® probes specific to each target gene. The results are analyzed using the ABI PRISM 7700 Sequence Detector. The absolute numbers are relative levels of expression of the target gene in a particular tissue compared to the calibrator tissue.

One of ordinary skill can design appropriate primers. The relative levels of expression of the OSNA versus normal tissues and other cancer tissues can then be determined. All the values are compared to the calibrator. Normal RNA samples are commercially available pools, originated by pooling samples of a particular tissue from different individuals.

The relative levels of expression of the OSNA in pairs of matched samples may also be determined. A matched pair is formed by mRNA from the cancer sample for a particular tissue and mRNA from the normal adjacent sample for that same tissue from the same individual. All the values are compared to the calibrator.

In the analysis of matching samples, the OSNAs that show a high degree of tissue specificity for the tissue of interest.

These results confirm the tissue specificity results obtained with normal pooled samples. Further, the level of mRNA expression in cancer samples and the isogenic normal adjacent tissue from the same individual are compared. This comparison provides an indication of specificity for the cancer state (e.g. higher levels of mRNA expression in the cancer sample compared to the normal adjacent).

Altogether, the high level of tissue specificity, plus the mRNA overexpression in matched samples tested are indicative of SEQ ID NO: 1-248 being a diagnostic marker and/or a therapeutic target for cancer.

Example 3

Protein Expression

The OSNA is amplified by polymerase chain reaction (PCR) and the amplified DNA fragment encoding the OSNA is subcloned in pET-21 d for expression in *E. coli*. In addition to the OSNA coding sequence, codons for two amino acids, Met-Ala, flanking the $NH_2$-terminus of the coding sequence of OSNA, and six histidines, flanking the COOH-terminus of the coding sequence of OSNA, are incorporated to serve as initiating Met/restriction site and purification tag, respectively.

An overexpressed protein band of the appropriate molecular weight may be observed on a Coomassie blue stained polyacrylamide gel. This protein band is confirmed by Western blot analysis using monoclonal antibody against 6× Histidine tag.

Large-scale purification of OSP is achieved using cell paste generated from 6-liter bacterial cultures, and purified using immobilized metal affinity chromatography (IMAC). Soluble fractions that are separated from total cell lysate were incubated with a nickel chelating resin. The column is packed and washed with five column volumes of wash buffer. OSP is eluted stepwise with various concentration imidazole buffers.

Example 4

Fusion Proteins

The human Fc portion of the IgG molecule can be PCR amplified, using primers that span the 5' and 3' ends of the sequence described below. These primers also should have convenient restriction enzyme sites that will facilitate cloning into an expression vector, preferably a mammalian expression vector. For example, if pC4 (Accession No. 209646) is used, the human Fc portion can be ligated into the BamHI cloning site. Note that the 3' BamHI site should be destroyed. Next, the vector containing the human Fc portion is re-restricted with BamHI, linearizing the vector, and a polynucleotide of the present invention, isolated by the PCR protocol described in Example 2, is ligated into this BamHI site. Note that the polynucleotide is cloned without a stop codon, otherwise a fusion protein will not be produced. If the naturally occurring signal sequence is used to produce the secreted protein, pC4 does not need a second signal peptide. Alternatively, if the naturally occurring signal sequence is not used, the vector can be modified to include a heterologous signal sequence. See, e.g., WO 96/34891.

Example 5

Production of an Antibody from a Polypeptide

In general, such procedures involve immunizing an animal (preferably a mouse) with polypeptide or, more preferably, with a secreted polypeptide-expressing cell. Such cells may be cultured in any suitable tissue culture medium; however, it is preferable to culture cells in Earle's modified Eagle's medium supplemented with 10% fetal bovine serum (inactivated at about 56° C.), and supplemented with about 10 g/l of nonessential amino acids, about 1,000 U/ml of penicillin, and about 100, µg/ml of streptomycin. The splenocytes of such mice are extracted and fused with a suitable myeloma cell line. Any suitable myeloma cell line may be employed in accordance with the present invention; however, it is preferable to employ the parent myeloma cell line (SP20), available from the ATCC. After fusion, the resulting hybridoma cells are selectively maintained in HAT medium, and then cloned by limiting dilution as described by Wands et al., *Gastroenterology* 80: 225-232 (1981).

The hybridoma cells obtained through such a selection are then assayed to identify clones which secrete antibodies capable of binding the polypeptide. Alternatively, additional antibodies capable of binding to the polypeptide can be produced in a two-step procedure using anti-idiotypic antibodies. Such a method makes use of the fact that antibodies are themselves antigens, and therefore, it is possible to obtain an antibody which binds to a second antibody. In accordance with this method, protein specific antibodies are used to immunize an animal, preferably a mouse. The splenocytes of such an animal are then used to produce hybridoma cells, and the hybridoma cells are screened to identify clones which produce an antibody whose ability to bind to the protein-specific antibody can be blocked by the polypeptide. Such antibodies comprise anti-idiotypic antibodies to the protein specific antibody and can be used to immunize an animal to induce formation of further protein-specific antibodies.

Example 6

Method of Determining Alterations in a Gene Corresponding to a Polynucleotide

RNA is isolated from individual patients or from a family of individuals that have a phenotype of interest. cDNA is then generated from these RNA samples using protocols known in the art. See, Sambrook (2001), supra. The cDNA is then used as a template for PCR, employing primers surrounding regions of interest in SEQ ID NO: 1-248. Suggested PCR conditions consist of 35 cycles at 95° C. for 30 seconds; 60-120 seconds at 52-58° C.; and 60-120 seconds at 70° C., using buffer solutions described in Sidransky et al., *Science* 252(5006): 706-9 (1991). See also Sidransky et al., *Science* 278(5340): 1054-9 (1997).

PCR products are then sequenced using primers labeled at their 5' end with T4 polynucleotide kinase, employing SequiTherm Polymerase. (Epicentre Technologies). The intron-exon borders of selected exons are also determined and genomic PCR products analyzed to confirm the results. PCR products harboring suspected mutations are then cloned and sequenced to validate the results of the direct sequencing. PCR products is cloned into T-tailed vectors as described in Holton et al.; *Nucleic Acids Res.*, 19: 1156 (1991) and sequenced with T7 polymerase (United States Biochemical). Affected individuals are identified by mutations not present in unaffected individuals.

Genomic rearrangements may also be determined. Genomic clones are nick-translated with digoxigenin deoxyuridine 5' triphosphate (Boehringer Manheim), and FISH is performed as described in Johnson et al., *Methods Cell Biol.* 35: 73-99 (1991). Hybridization with the labeled probe is carried out using a vast excess of human cot-1 DNA for specific hybridization to the corresponding genomic locus.

Chromosomes are counterstained with 4,6-diamino-2-phenylidole and propidium iodide, producing a combination of C- and R-bands. Aligned images for precise mapping are obtained using a triple-band filter set (Chroma Technology, Brattleboro, Vt.) in combination with a cooled charge-coupled device camera (Photometrics, Tucson, Ariz.) and variable excitation wavelength filters. Johnson (1991). Image collection, analysis and chromosomal fractional length measurements are performed using the ISee Graphical Program System. (Inovision Corporation, Durham, N.C.) Chromosome alterations of the genomic region hybridized by the probe are identified as insertions, deletions, and translocations. These alterations are used as a diagnostic marker for an associated disease.

Example 7

Method of Detecting Abnormal Levels of a Polypeptide in a Biological Sample

Antibody-sandwich ELISAs are used to detect polypeptides in a sample, preferably a biological sample. Wells of a microtiter plate are coated with specific antibodies, at a final concentration of 0.2 to 10 ug/ml. The antibodies are either monoclonal or polyclonal and are produced by the method described above. The wells are blocked so that non-specific binding of the polypeptide to the well is reduced. The coated wells are then incubated for >2 hours at RT with a sample containing the polypeptide. Preferably, serial dilutions of the sample should be used to validate results. The plates are then washed three times with deionized or distilled water to remove unbound polypeptide. Next, 50 µl of specific antibody-alkaline phosphatase conjugate, at a concentration of 25-400 ng, is added and incubated for 2 hours at room temperature. The plates are again washed three times with deionized or distilled water to remove unbound conjugate. 75 µl of 4-methylumbelliferyl phosphate (MUP) or p-nitrophenyl phosphate (NPP) substrate solution are added to each well and incubated 1 hour at room temperature.

The reaction is measured by a microtiter plate reader. A standard curve is prepared, using serial dilutions of a control sample, and polypeptide concentrations are plotted on the X-axis (log scale) and fluorescence or absorbance on the Y-axis (linear scale). The concentration of the polypeptide in the sample is calculated using the standard curve.

Example 8

Formulating a Polypeptide

The secreted polypeptide composition will be formulated and dosed in a fashion consistent with good medical practice, taking into account the clinical condition of the individual patient (especially the side effects of treatment with the secreted polypeptide alone), the site of delivery, the method of administration, the scheduling of administration, and other factors known to practitioners. The "effective amount" for purposes herein is thus determined by such considerations.

As a general proposition, the total pharmaceutically effective amount of secreted polypeptide administered parenterally per dose will be in the range of about 1, µg/kg/day to 10 mg/kg/day of patient body weight, although, as noted above, this will be subject to therapeutic discretion. More preferably, this dose is at least 0.01 mg/kg/day, and most preferably for humans between about 0.01 and 1 mg/kg/day for the hormone. If given continuously, the secreted polypeptide is typically administered at a dose rate of about 1 µg/kg/hour to about 50 mg/kg/hour, either by 14 injections per day or by continuous subcutaneous infusions, for example, using a mini-pump. An intravenous bag solution may also be employed. The length of treatment needed to observe changes and the interval following treatment for responses to occur appears to vary depending on the desired effect.

Pharmaceutical compositions containing the secreted protein of the invention are administered orally, rectally, parenterally, intracistemally, intravaginally, intraperitoneally, topically (as by powders, ointments, gels, drops or transdermal patch), bucally, or as an oral or nasal spray. "Pharmaceutically acceptable carrier" refers to a non-toxic solid, semisolid or liquid filler, diluent, encapsulating material or formulation auxiliary of any type. The term "parenteral" as used herein refers to modes of administration which include intravenous, intramuscular, intraperitoneal, intrasternal, subcutaneous and intraarticular injection and infusion.

The secreted polypeptide is also suitably administered by sustained-release systems. Suitable examples of sustained-release compositions include semipermeable polymer matrices in the form of shaped articles, e.g., films, or microcapsules. Sustained-release matrices include polylactides (U.S. Pat. No. 3,773,919, EP 58,481, the contents of which are hereby incorporated by reference herein in their entirety), copolymers of L-glutamic acid and gamma-ethyl-L-glutamate (Sidman, U. et al., *Biopolymers* 22: 547-556 (1983)), poly(2-hydroxyethyl methacrylate) (R. Langer et al., *J. Biomed. Mater. Res.* 15: 167-277 (1981), and R Langer, Chem. Tech. 12: 98-105 (1982)), ethylene vinyl acetate (R. Langer et al.) or poly-D-(−)-3-hydroxybutyric acid (EP 133, 988). Sustained-release compositions also include liposomally entrapped polypeptides. Liposomes containing the secreted polypeptide are prepared by methods known per se: D E Epstein et al., *Proc. Natl. Acad. Sci. USA* 82: 3688-3692 (1985); Hwang et al., *Proc. Natl. Acad. Sci. USA* 77: 40304034 (1980); EP 52,322; EP 36,676; EP 88,046; EP 143,949; EP 142,641; Japanese Pat. Appl. 83-118008; U.S. Pat. Nos. 4,485,045 and 4,544,545; and EP 102,324, the contents of which are hereby incorporated by reference herein in their entirety. Ordinarily, the liposomes are of the small (about 200-800 Angstroms) unilamellar type in which the lipid content is greater than about 30 mol. percent cholesterol, the selected proportion being adjusted for the optimal secreted polypeptide therapy.

For parenteral administration, in one embodiment, the secreted polypeptide is formulated generally by mixing it at the desired degree of purity, in a unit dosage injectable form (solution, suspension, or emulsion), with a pharmaceutically acceptable carrier, i.e., one that is non-toxic to recipients at the dosages and concentrations employed and is compatible with other ingredients of the formulation.

For example, the formulation preferably does not include oxidizing agents and other compounds that are known to be deleterious to polypeptides. Generally, the formulations are prepared by contacting the polypeptide uniformly and intimately with liquid carriers or finely divided solid carriers or both. Then, if necessary, the product is shaped into the desired formulation. Preferably, the carrier is a parenteral carrier, more preferably, a solution that is isotonic with the blood of the recipient. Examples of such carrier vehicles include water, saline, Ringer's solution, and dextrose solution. Non-aqueous vehicles such as fixed oils and ethyl oleate are also useful herein, as well as liposomes.

The carrier suitably contains minor amounts of additives such as substances that enhance isotonicity and chemical stability. Such materials are non-toxic to recipients at the dosages and concentrations employed, and include buffers such as phosphate, citrate, succinate, acetic acid, and other organic acids or their salts; antioxidants such as ascorbic acid; low molecular weight (less than about ten residues) polypeptides, e.g., polyarginine or tripeptides; proteins, such as serum albumin, gelatin, or immunoglobulins; hydrophilic polymers such as polyvinylpyrrolidone; amino acids, such as glycine, glutamic acid, aspartic acid, or arginine; monosaccharides, disaccharides, and other carbohydrates including cellulose or its derivatives, glucose, manose, or dextrins; chelating agents such as EDTA; sugar alcohols such as mannitol or sorbitol; counterions such as sodium; and/or nonionic surfactants such as polysorbates, poloxamers, or PEG.

The secreted polypeptide is typically formulated in such vehicles at a concentration of about 0.1 mg/ml to 100 mg/ml, preferably 1-10 mg/ml, at a pH of about 3 to 8. It will be understood that the use of certain of the foregoing excipients, carriers, or stabilizers will result in the formation of polypeptide salts.

Any polypeptide to be used for therapeutic administration can be sterile. Sterility is readily accomplished by filtration through sterile filtration membranes (e.g., 0.2 micron membranes). Therapeutic polypeptide compositions generally are placed into a container having a sterile access port, for example, an intravenous solution bag or vial having a stopper pierceable by a hypodermic injection needle.

Polypeptides ordinarily will be stored in unit or multi-dose containers, for example, sealed ampules or vials, as an aqueous solution or as a lyophilized formulation for reconstitution. As an example of a lyophilized formulation, 10-ml vials are filled with 5 ml of sterile-filtered 1% (w/v) aqueous polypeptide solution, and the resulting mixture is lyophilized. The infusion solution is prepared by reconstituting the lyophilized polypeptide using bacteriostatic Water-for-Injection.

The invention also provides a pharmaceutical pack or kit comprising one or more containers filled with one or more of the ingredients of the pharmaceutical compositions of the invention. Associated with such container(s) can be a notice in the form prescribed by a governmental agency regulating the manufacture, use or sale of pharmaceuticals or biological products, which notice reflects approval by the agency of manufacture, use or sale for human administration. In addition, the polypeptides of the present invention may be employed in conjunction with other therapeutic compounds.

Example 9

Method of Treating Decreased Levels of the Polypeptide

It will be appreciated that conditions caused by a decrease in the standard or normal expression level of a secreted protein in an individual can be treated by administering the polypeptide of the present invention, preferably in the secreted form. Thus, the invention also provides a method of treatment of an individual in need of an increased level of the polypeptide comprising administering to such an individual a pharmaceutical composition comprising an amount of the polypeptide to increase the activity level of the polypeptide in such an individual.

For example, a patient with decreased levels of a polypeptide receives a daily dose 0.1-100 ug/kg of the polypeptide for six consecutive days. Preferably, the polypeptide is in the secreted form. The exact details of the dosing scheme, based on administration and formulation, are provided above.

Example 10

Method of Treating Increased Levels of the Polypeptide

Antisense or RNAi technology are used to inhibit production of a polypeptide of the present invention. This technology is one example of a method of decreasing levels of a polypeptide, preferably a secreted form, due to a variety of etiologies, such as cancer.

For example, a patient diagnosed with abnormally increased levels of a polypeptide is administered intravenously antisense polynucleotides at 0.5, 1.0, 1.5, 2.0 and 3.0 mg/kg day for 21 days. This treatment is repeated after a 7-day rest period if the treatment was well tolerated. The formulation of the antisense polynucleotide is provided above.

Example 11

Method of Treatment Using Gene Therapy

One method of gene therapy transplants fibroblasts, which are capable of expressing a polypeptide, onto a patient Generally, fibroblasts are obtained from a subject by skin biopsy. The resulting tissue is placed in tissue-culture medium and separated into small pieces. Small chunks of the tissue are placed on a wet surface of a tissue culture flask, approximately ten pieces are placed in each flask. The flask is turned upside down, closed tight and left at room temperature over night. After 24 hours at room temperature, the flask is inverted and the chunks of tissue remain fixed to the bottom of the flask and fresh media (e.g., Ham's F12 media, with 10% FBS, penicillin and streptomycin) is added. The flasks are then incubated at 37° C. for approximately one week.

At this time, fresh media is added and subsequently changed every several days. After an additional two weeks in culture, a monolayer of fibroblasts emerge. The monolayer is trypsinized and scaled into larger flasks. pMV-7 (Kirschmeier, P. T. et al., *DNA*, 7: 219-25 (1988)), flanked by the long terminal repeats of the Moloney murine sarcoma virus, is digested with EcoRI and HindIII and subsequently treated with calf intestinal phosphatase. The linear vector is fractionated on agarose gel and purified, using glass beads.

The cDNA encoding a polypeptide of the present invention can be amplified using PCR primers which correspond to the 5' and 3' end sequences respectively as set forth in Example 3. Preferably, the 5' primer contains an EcoRI site and the 3' primer includes a HindIII site. Equal quantities of the Moloney murine sarcoma virus linear backbone and the amplified EcoRI and HindIII fragment are added together, in the presence of T4 DNA ligase. The resulting mixture is maintained under conditions appropriate for ligation of the two fragments. The ligation mixture is then used to transform bacteria HB 101, which are then plated onto agar containing kanamycin for the purpose of confirming that the vector has the gene of interest properly inserted.

The amphotropic pA317 or GP+am12 packaging cells are grown in tissue culture to confluent density in Dulbecco's Modified Eagles Medium (DMEM) with 10% calf serum (CS), penicillin and streptomycin. The MSV vector containing the gene is then added to the media and the packaging cells transduced with the vector. The packaging cells now produce infectious viral particles containing the gene (the packaging cells are now-referred to as producer cells).

Fresh media is added to the transduced producer cells, and subsequently, the media is harvested from a 10 cm plate of confluent producer cells. The spent media, containing the infectious viral particles, is filtered through a millipore filter to remove detached producer cells and this media is then used to infect fibroblast cells. Media is removed from a sub-confluent plate of fibroblasts and quickly replaced with the media from the producer cells. This media is removed and replaced with fresh media.

If the titer of virus is high, then virtually all fibroblasts will be infected and no selection is required. If the titer is very low, then it is necessary to use a retroviral vector that has a selectable marker, such as neo or his. Once the fibroblasts have been efficiently infected, the fibroblasts are analyzed to determine whether protein is produced.

The engineered fibroblasts are then transplanted onto the host, either alone or after having been grown to confluence on cytodex 3 microcarrier beads.

Example 12

Method of Treatment Using Gene Therapy—In Vivo

Another aspect of the present invention is using in vivo gene therapy methods to treat disorders, diseases and conditions. The gene therapy method relates to the introduction of naked nucleic acid (DNA, RNA, and antisense DNA or RNA) sequences into an animal to increase or decrease the expression of the polypeptide.

The polynucleotide of the present invention may be operatively linked to a promoter or any other genetic elements necessary for the expression of the polypeptide by the target tissue. Such gene therapy and delivery techniques and methods are known in the art, see, for example, Tabata H. et al. *Cardiovasc. Res.* 35 (3): 470479 (1997); Chao J et al. *Pharmacol. Res.* 35 (6): 517-522 (1997); Wolff J. A. *Neuromuscul. Disord.* 7 (5): 314-318 (1997), Schwartz B. et al. *Gene Ther.* 3 (5): 405411 (1996); and Tsurumi Y. et al. *Circulation* 94 (12): 3281-3290 (1996); WO 90/11092, WO 98/11779; U.S. Pat. Nos. 5,693,622; 5,705,151; 5,580,859, the contents of which are hereby incorporated by reference herein in their entirety.

The polynucleotide constructs may be delivered by any method that delivers injectable materials to the cells of an animal, such as, injection into the interstitial space of tissues (heart, muscle, skin, ovarian, liver, intestine and the like). The polynucleotide constructs can be delivered in a pharmaceutically acceptable liquid or aqueous carrier.

The term "naked" polynucleotide, DNA or RNA, refers to sequences that are free from any delivery vehicle that acts to assist, promote, or facilitate entry into the cell, including viral sequences, viral particles, liposome formulations, lipofectin or precipitating agents and the like. However, the polynucleotides of the present invention may also be delivered in liposome formulations (such as those taught in Felgner P. L. et al. *Ann. NY Acad. Sci.* 772: 126-139 (1995) and Abdallah B. et al. *Biol. Cell* 85 (1): 1-7 (1995)) which can be prepared by methods well known to those skilled in the art.

The polynucleotide vector constructs used in the gene therapy method are preferably constructs that will not integrate into the host genome nor will they contain sequences that allow for replication. Any strong promoter known to those skilled in the art can be used for driving the expression of DNA. Unlike other gene therapies techniques, one major advantage of introducing naked nucleic acid sequences into target cells is the transitory nature of the polynucleotide synthesis in the cells. Studies have shown that nonreplicating DNA sequences can be introduced into cells to provide production of the desired polypeptide for periods of up to six months.

The polynucleotide construct can be delivered to the interstitial space of tissues within the an animal, including of muscle, skin, brain, ovarian, liver, spleen, bone marrow, thymus, heart, lymph, blood, bone, cartilage, pancreas, kidney, gall bladder, stomach, intestine, testis, ovary, uterus, rectum, nervous system, eye, gland, and connective tissue. Interstitial space of the tissues comprises the intercellular fluid, mucopolysaccharide matrix among the reticular fibers of organ tissues, elastic fibers in the walls of vessels or chambers, collagen fibers of fibrous tissues, or that same matrix within connective tissue ensheathing muscle cells or in the lacunae of bone. It is similarly the space occupied by the plasma of the circulation and the lymph fluid of the lymphatic channels. Delivery to the interstitial space of muscle tissue is preferred for the reasons discussed below. They may be conveniently delivered by injection into the tissues comprising these cells. They are preferably delivered to and expressed in persistent, non-dividing cells which are differentiated, although delivery and expression may be achieved in non-differentiated or less completely differentiated cells, such as, for example, stem cells of blood or skin fibroblasts. In vivo muscle cells are particularly competent in their ability to take up and express polynucleotides.

For the naked polynucleotide injection, an effective dosage amount of DNA or RNA will be in the range of from about 0.05 μg/kg body weight to about 50 mg/kg body weight. Preferably the dosage will be from about 0.005 mg/kg to about 20 mg/kg and more preferably from about 0.05 mg/kg to about 5 mg/kg. Of course, as the artisan of ordinary skill will appreciate, this dosage will vary according to the tissue site of injection. The appropriate and effective dosage of nucleic acid sequence can readily be determined by those of ordinary skill in the art and may depend on the condition being treated and the route of administration. The preferred route of administration is by the parenteral route of injection into the interstitial space of tissues. However, other parenteral routes may also be used, such as, inhalation of an aerosol formulation particularly for delivery to ovarians or bronchial tissues, throat or mucous membranes of the nose. In addition, naked polynucleotide constructs can be delivered to arteries during angioplasty by the catheter used in the procedure.

The dose response effects of injected polynucleotide in muscle in vivo is determined as follows. Suitable template DNA for production of mRNA coding for polypeptide of the present invention is prepared in accordance with a standard recombinant DNA methodology. The template DNA, which may be either circular or linear, is either used as naked DNA or complexed with liposomes. The quadriceps muscles of mice are then injected with various amounts of the template DNA.

Five to six week old female and male Balb/C mice are anesthetized by intraperitoneal injection with 0.3 ml of 2.5%

Avertin. A 1.5 cm incision is made on the anterior thigh, and the quadriceps muscle is directly visualized. The template DNA is injected in 0.1 ml of carrier in a 1 cc syringe through a 27 gauge needle over one minute, approximately 0.5 cm from the distal insertion site of the muscle into the knee and about 0.2 cm deep. A suture is placed over the injection site for future localization, and the skin is closed with stainless steel clips.

After an appropriate incubation time (e.g., 7 days) muscle extracts are prepared by excising the entire quadriceps. Every fifth 15 um cross-section of the individual quadriceps muscles is histochemically stained for protein expression. A time course for protein expression may be done in a similar fashion except that quadriceps from different mice are harvested at different times. Persistence of DNA in muscle following injection may be determined by Southern blot analysis after preparing total cellular DNA and HIRT supernatants from injected and control mice.

The results of the above experimentation in mice can be use to extrapolate proper dosages and other treatment parameters in humans and other animals using naked DNA.

Example 13

Transgenic Animals

The polypeptides of the invention can also be expressed in transgenic animals. Animals of any species, including, but not limited to, mice, rats, rabbits, hamsters, guinea pigs, pigs, micro-pigs, goats, sheep, cows and non-human primates, e.g., baboons, monkeys, and chimpanzees may be used to generate transgenic animals. In a specific embodiment, techniques described herein or otherwise known in the art, are used to express polypeptides of the invention in humans, as part of a gene therapy protocol.

Any technique known in the art may be used to introduce the transgene (I.e., polynucleotides of the invention) into animals to produce the founder lines of transgenic animals. Such techniques include, but are not limited to, pronuclear microinjection (Paterson et al., *Appl. Microbiol. Biotechnol.* 40: 691-698 (1994); Carver et al., *Biotechnology* 11: 1263-1270 (1993); Wright et al., *Biotechnology* 9: 830-834 (1991); and U.S. Pat. No. 4,873,191, the contents of which is hereby incorporated by reference herein in its entirety); retrovirus mediated gene transfer into germ lines (Van der Putten et al., *Proc. Natl. Acad. Sci., USA* 82: 6148-6152 (1985)), blastocysts or embryos; gene targeting in embryonic stem cells (Thompson et al., *Cell* 56: 313-321 (1989)); electroporation of cells or embryos (Lo, 1983, *Mol Cell. Biol.* 3: 1803-1814 (1983)); introduction of the polynucleotides of the invention using a gene gun (see, e.g., Ulmer et al., *Science* 259: 1745 (1993); introducing nucleic acid constructs into embryonic pleuripotent stem cells and transferring the stem cells back into the blastocyst; and sperm mediated gene transfer (Lavitrano et al., *Cell* 57: 717-723 (1989). For a review of such techniques, see Gordon, "Transgenic Animals," *Intl. Rev. Cytol.* 115: 171-229 (1989).

Any technique known in the art may be used to produce transgenic clones containing polynucleotides of the invention, for example, nuclear transfer into enucleated oocytes of nuclei from cultured embryonic, fetal, or adult cells induced to quiescence (Campell et al., *Nature* 380: 64-66 (1996); Wilmut et al., *Nature* 385: 810813 (1997)).

The present invention provides for transgenic animals that carry the transgene in all their cells, as well as animals which carry the transgene in some, but not all their cells, I.e., mosaic animals or chimeric. The transgene may be integrated as a single transgene or as multiple copies such as in concatamers, e.g., head-to-head tandems or head-to-tail tandems. The transgene may also be selectively introduced into and activated in a particular cell type by following, for example, the teaching of Lasko et al. (Lasko et al., *Proc. Natl. Acad. Sci. USA* 89: 6232-6236 (1992)). The regulatory sequences required for such a cell-type specific activation will depend upon the particular cell type of interest, and will be apparent to those of skill in the art. When it is desired that the polynucleotide transgene be integrated into the chromosomal site of the endogenous gene, gene targeting is preferred. Briefly, when such a technique is to be utilized, vectors containing some nucleotide sequences homologous to the endogenous gene are designed for the purpose of integrating, via homologous recombination with chromosomal sequences, into and disrupting the function of the nucleotide sequence of the endogenous gene. The transgene may also be selectively introduced into a particular cell type, thus inactivating the endogenous gene in only that cell type, by following, for example, the teaching of Gu et al. (Gu et al., *Science* 265: 103-106 (1994)). The regulatory sequences required for such a cell-type specific inactivation will depend upon the particular cell type of interest, and will be apparent to those of skill in the art.

Once transgenic animals have been generated, the expression of the recombinant gene may be assayed utilizing standard techniques. Initial screening may be accomplished by Southern blot analysis or PCR techniques to analyze animal tissues to verify that integration of the transgene has taken place. The level of mRNA expression of the transgene in the tissues of the transgenic animals may also be assessed using techniques which include, but are not limited to, Northern blot analysis of tissue samples obtained from the animal, in situ hybridization analysis, and reverse transcriptase-PCR (rt-PCR). Samples of transgenic gene-expressing tissue may also be evaluated immunocytochemically or immunohistochemically using antibodies specific for the transgene product.

Once the founder animals are produced, they may be bred, inbred, outbred, or crossbred to produce colonies of the particular animal. Examples of such breeding strategies include, but are not limited to: outbreeding of founder animals with more than one integration site in order to establish separate lines; inbreeding of separate lines in order to produce compound transgenics that express the transgene at higher levels because of the effects of additive expression of each transgene; crossing of heterozygous transgenic animals to produce animals homozygous for a given integration site in order to both augment expression and eliminate the need for screening of animals by DNA analysis; crossing of separate homozygous lines to produce compound heterozygous or homozygous lines; and breeding to place the transgene on a distinct background that is appropriate for an experimental model of interest.

Transgenic animals of the invention have uses which include, but are not limited to, animal model systems useful in elaborating the biological function of polypeptides of the present invention, studying conditions and/or disorders associated with aberrant expression, and in screening for compounds effective in ameliorating such conditions and/or disorders.

Example 14

Knock-Out Animals

Endogenous gene expression can also be reduced by inactivating or "knocking out" the gene and/or its promoter using targeted homologous recombination. (E.g., see Smithies et al., Nature 317: 230-234 (1985); Thomas & Capecchi, Cell 51: 503512 (1987); Thompson et al., Cell 5: 313-321 (1989)) Alternatively, RNAi technology may be used. For example, a mutant, non-functional polynucleotide of the invention (or a completely unrelated DNA sequence) flanked by DNA homologous to the endogenous polynucleotide sequence (either the coding regions or regulatory regions of the gene) can be used, with or without a selectable marker and/or a negative selectable marker, to transfect cells that express polypeptides of the invention in vivo. In another embodiment, techniques known in the art are used to generate knockouts in cells that contain, but do not express the gene of interest. Insertion of the DNA construct, via targeted homologous recombination, results in inactivation of the targeted gene. Such approaches are particularly suited in research and agricultural fields where modifications to embryonic stem cells can be used to generate animal offspring with an inactive targeted gene (e.g., see Thomas & Capecchi 1987 and Thompson 1989, supra). However, this approach can be routinely adapted for use in humans provided the recombinant DNA constructs are directly administered or targeted to the required site in vivo using appropriate viral vectors that will be apparent to those of skill in the art.

In further embodiments of the invention, cells that are genetically engineered to express the polypeptides of the invention, or alternatively, that are genetically engineered not to express the polypeptides of the invention (e.g., knockouts) are administered to a patient in vivo. Such cells may be obtained from the patient (i.e., animal, including human) or an MHC compatible donor and can include, but are not limited to fibroblasts, bone marrow cells, blood cells (e.g., lymphocytes), adipocytes, muscle cells, endothelial cells etc. The cells are genetically engineered in vitro using recombinant DNA techniques to introduce the coding sequence of polypeptides of the invention into the cells, or alternatively, to disrupt the coding sequence and/or endogenous regulatory sequence associated with the polypeptides of the invention, e.g., by transduction (using viral vectors, and preferably vectors that integrate the transgene into the cell genome) or transfection procedures, including, but not limited to, the use of plasmids, cosmids, YACs, naked DNA, electroporation, liposomes, etc.

The coding sequence of the polypeptides of the invention can be placed under the control of a strong constitutive or inducible promoter or promoter/enhancer to achieve expression, and preferably secretion, of the polypeptides of the invention. The engineered cells which express and preferably secrete the polypeptides of the invention can be introduced into the patient systemically, e.g., in the circulation, or intraperitoneally.

Alternatively, the cells can be incorporated into a matrix and implanted in the body, e.g., genetically engineered fibroblasts can be implanted as part of a skin graft; genetically engineered endothelial cells can be implanted as part of a lymphatic or vascular graft. (See, for example, Anderson et al. U.S. Pat. No. 5,399,349; and Mulligan & Wilson, U.S. Pat. No. 5,460,959, the contents of which are hereby incorporated by reference herein in their entirety).

When the cells to be administered are non-autologous or non-MHC compatible cells, they can be administered using well known techniques which prevent the development of a host immune response against the introduced cells. For example, the cells may be introduced in an encapsulated form which, while allowing for an exchange of components with the immediate extracellular environment, does not allow the introduced cells to be recognized by the host immune system.

Transgenic and "knock-out" animals of the invention have uses which include, but are not limited to, animal model systems useful in elaborating the biological function of polypeptides of the present invention, studying conditions and/or disorders associated with aberrant expression, and in screening for compounds effective in ameliorating such conditions and/or disorders.

While preferred illustrative embodiments of the present invention are described, one skilled in the art will appreciate that the present invention can be practiced by other than the described embodiments, which are presented for purposes of illustration only and not by way of limitation. The present invention is limited only by the claims that follow.

---

SEQUENCE LISTING (396 sequences)

SEQ ID NO: 1 - DNA, 272 bp, Homo sapien
tgaatctccacacagtcaagtctgatgtgtttgacagttcctgggatgtctctacagtagctcctcttgaaatctaaagcaacatgtccacattgtaaaccactttcaaagatagtaataaaagttaaaaagttgggggaggtcagggaaacagactagataagaaacagcaaggaaacaaatacaaaacatggcagaggaagatcatccacagtctatattatggcagtgaagaggaatgtgttaacactcctctgtaagaagaaaaagat

SEQ ID NO: 2 - DNA, 288 bp, Homo sapien
atctttttcttcttacagaggagtgttaacacattcctcttcactgccataatatagactgtggatgatcttcctctgccatgttttgtttttgtttccttgctgtttcttatctagtctgtttccctgacctcccccaactttttaacttttattactatctttgaaagtggtttacaatgtggacatgttgctttagatttcaagaggagctactgtagagacatcccaggaactgtcaaacacatcagacttgactgtgtggagattcatcctcgtgagcctcct

SEQ ID NO: 3 - DNA, 1182 bp, Homo sapien
gtagcatttccggcaggtgcctgagggaaagtgtggcagggctcttctctctgtctctctttcccctctgagatatgcacctggttataattcttctctgtcttaatcccaattcaagctcaggccgtccagggccacaggcctctgtgatctggcagctacaatcagaacatctaacagtgccccacactaccccccgccctcccctgagccatcagctccacgactggcccttgctttgggctgtcttctcttgggagctgggagggtcctaaagatgaggagatgggtctggtctcaaaagagatatcggcagacacaaattcttaatggctttgctttcttgagtatgacgtgttctcaagcccctcaaagcccgcatggcctgccctcgatctggcccctccaaccgacactccccaaggctttctgccctcgcagcccaggtggaagtccggctctccaagcctcacactctcccatggctgggggatgttgttggtcagctgttaagtggaaaggaggaccgagaggaggtctgggctcagcccctgggaccagggcagtggcactcatactcactaacctgagaaggtgcccatagggcagggcagggccacccctgtgcccactggacagaagtgacctagagggcagggccctcccgcagtcacatggatgcctttattgggatgagtgacctcagctcttgcccagagaatcagaagtggctgagattgcagagcagccctccctggcccccagtcaggctctcgaccacccccagctcacacacccctgcagtgggacatttcccagaataagggagcagagctcgcgagctggagtgacagtgccctccactgccagggtggctctcaagcccagggacggcagtgggcccctgagatgcggccccttctgaattaattcttggctatctgtgccagaccctgcttaggagcccaaagctggggagaaagcatgggggttccaggacttgcccatcctgtggaaaggtgggtgtggtgccttcagccccactcttggtgtggagggcactgcaaggcactgaagagttggggctccagaccccactcagggagcctccagatgagtgttctagaaacctgcttccactccagctaagcttgttttcatttacatattcattatgtcatc

SEQ ID NO: 4 - DNA, 1249 bp, Homo sapien
acttgtcagtgtaatttttattaaattaggtccatctcattcagaaagggtttgagcaaaccataagtgatgacataatgaatatgtaaatgaaaacaagcttagctggagtggaagcaggtttctagaacactcatctggaggctccctgagtggggtctggagccccaactcttcagtgccttgcagtgccctccacaccaagagtggggctgaaggcaccacacccacctttccacaggatgggcaagtcctggaacccccatgctttctccccagctttgggctcctaagcagggtctggcacagatagccaagaattaattcagaaggggccgcatctcagggcccactgccgtccctgggcttgagagccaccctggcagtggagggcactgtcactccagctcgcgagctctgctcccttattctgggaaatgtcccactgcaggggtgtgtgagctgggggtggtcgagagcctgactgggggccagggagggctgctctgcaatctcagccacttctgattctctgggcaagagctgaggtcactcatcccaataaaggcatccatgtgactgcgggagggccctgccctctaggtcacttctgtccagtgggcacaggggtggccctgccctgccctatgggcaccttctcaggttagtgagtatgagtgccactgccctggtcccaggggctgagcccagacctcctctcggtcctcctttccacttaacagctgaccaacaacatcccccagccatgggagagtgtgaggcttggagagccggacttccacctgggctgcgagggcagaaagccttggggagtgtcggttggaggggccagatcgagggcaggccatgcgggctttgaggggcttgagaacacgtcatactcaagaaagcaaagccattaagaatttgtgtctgccgatatctcttttgagaccagacccatctcctcatctttaggaccctcccagctcccaagagaagacagcccaaagcaagggccagtcgtggagctgatggctcaggggagggcggggggtagtgtggggcactgttagatgttctgattgtagctgccagatcacagaggcctgtggccctggacggcctgagcttgaattgggattaagacagagaagaattataaccaggtgcatatctcagaggggaaagagagacagagagaagagccctgccacactttccctcaggcacctgccggaaatgctac

SEQ ID NO: 5 - DNA, 1246 bp, Homo sapien
gcatttccggcaggtgcctgagggaaagtgtggcagggctcttctctctgtctctctttcccctctgagatatgcacctggttataattcttctctgtcttaatcccaattcaagctcaggccgtccagggccacaggcctctgtgatctggcagctacaatcagaacatctaacagtgccccacactaccccccgccctcccctgagccatcagctccacgactggcccttgctttgggctgtcttctcttgggagctgggagggtcctaaagatgaggagatgggtctggtctcaaaagagatatcggcagacacaaattcttaatggctttgctttcttgagtatgacgtgttctcaagcccctcaaagcccgcatggcctgccctcgatctggcccctccaaccgacactccccaaggctttctgccctcgcagcccaggtggaagtccggctctccaagcctcacactctcccatggctgggggatgttgttggtcagctgttaagtggaaaggaggaccgagaggaggtctgggctcagcccctgggaccagggcagtggcactcatactcactaacctgagaaggtgcccatagggcagggcagggccacccctgtgcccactggacagaagtgacctagagggcagggccctcccgcagtcacatggatgcctttattgggatgagtgacctcagctcttgcccagagaatcagaagtggctgagattgcagagcagccctccctggcccccagtcaggctctcgaccacccccagctcacacacccctgcagtgggacatttcccagaataagggagcagagctcgcgagctggagtgacagtgccctccactgccagggtggctctcaagcccagggacggcagtgggccctgagatgcggccccttctgaattaattcttggctatctgtgccagaccctgcttaggagcccaaagctggggagaaagcatgggggttccaggacttgcccatcctgtggaaaggtgggtgtggtgccttcagccccactcttggtgtggagggcactgcaaggcactgaagagttggggctccagaccccactcagggagcctccagatgagtgttctagaaacctgcttccactccagctaagcttgttttcatttacatattcattatgtcatcacttatggtttgctcaaaccctttctgaatgagatggacctaatttaataaaaattacactgacaagt

SEQ ID NO: 6 - DNA, 250 bp, Homo sapien
gtgcaagtctgtggtggcccctgccacggatggtggcctcaacctgacctccaccttcctcaggaaaaaccagtgtgagacccgaaccatgctgctgctgcccgcggggtccctcggctcctacagctaccggagtccccactggggcagcacctactccgtgtcagtggtggagaccgactacgaccagtacgcgctgctgtacagccaaggcccagggcttcacagaggataccattgtcttcctgcc

SEQ ID NO: 7 - DNA, 530 bp, Homo sapien
gaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagtaa

SEQ ID NO: 8 - DNA, 968 bp, Homo sapien
  misc_feature (952)..(952): n=a, c, g or t
  misc_feature (958)..(958): n=a, c, g or t
tacttatattatttaaaaaacaattaatcaaataagttggttaggattagtttcagtggcataaacagaaacttaaacaatgtgaaagcttatttctgtctccttctgccaggtgaacacacagtgttcatcccctcaggaggacacagcttttgaggtaccatccttggaagcagagaccagccctcactagacacaaactgtcctggcacctagattttggacttcatagcctctagaactgtgctgggaagacaacacttctgaactatattttgacagagcaacatagtaaaagagtagcggtcattttaaatgaatctggggaaggaagtgcgctggagaaatccttagctgtcaggccaaggtggagagctctatgaagagtggctggaacttagaaatggttgcctctgctgttcagtgaaggagcaatggccttagagctattgagaatttgatgcaaaagaaggggaaatttgatgacatactgttagagaccactggattagcagaccctggtatcataactattgtggattcaaaatatggattaaaagtgaaataccactaaaggcagaagagaatgaaatcatcccacccactgacccgttcccaatctgagcatatggatagggcccaaagcagcaaagaattggacaacgttaaaatgacagctctctattctgaggacttgacacccgggctactgacattgttcttttcagttctacaaatgtgacagcatttaatgcaatagaagcaatgaatgaagttacccagagaagcatttaacagaagagaaacctgatggccttatcaatgaagctactaggcaagttgctttggcagatatcattctcattaataaaacagacttggtcccagaagaagatgtaaagaaattaagaacgacacttagatccataaatggactaggacaaatcttagnaacacnaagatcaagg

SEQ ID NO: 9 - DNA, 1807 bp, Homo sapien
cccggccaggccgggagtggcgtgctgggcgtgcgcggctgcggttacggcgtgttggtcccaggcggttcaactgaaggttaggaagttccgtaagccgggaatggtaaccggctgttggatcttgcggatgaggaggaggatcctggcggaggaggattgtcctagaattggttcccccaatgggagacgacgcaaaagcgaggcaggagggaaaagttcctggccttcgggcgccaagatcccagttcacaattatcaccgggtatttaggttgctgggaaaggaacaacacttcttggaactatatttttgacagagcaaccatagttaaaagagtagccggtcattttaaatgaatcctggggaaggaagtgccgctggagaaatccttaagctgtcagccaaggtggagagctctattgaagagtggcttggaacttagaaacggttgcctctgcttgttcagttgaagtgaggaatgtgtttactgtgtacatggtttactagaaatgtttattgattatatttccatgctttaattttcttggagtaatttaactgaatttacacagttttgcttcattgtattttcaaacaaatagaaaattaaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatatttctaagtgttcaaccttataaaaaaaataaatgactatcataaaagagaaaaaccttacattatgttctactagttaagttttcaaggacagtgttcactagtctaccatagaccctagaagagttacccaacacatagttagcactcaaatatttgtttgaatgaattataaaaatgactacttgtactgttaatttgtggtaatctaagggaattaaatctcttcggcatcatttactcccttaggtatttgactttgtgtcaaatgttttggcaaggataaaattataacagactttcttgaacaaccaaaatataatctattaaggattttccttcacttttgataaaataagaaaaaaggaaattaaacccttgcatcctaatgtaaaatagaattatatggtgtttaatatcagtgtctaatatagctattatattgacctcctatagttaatacattttatcattattttgtatgttggtttttaaaaatttcataaagctataaaaagatacttggtcagataaagtttcctctgcttttaattttaataaagtattattatgtatatgatttctttttacctattatatatatgcatctattgttttctcactggtaaatatgggacagacattttgttagaaggttagaagtgagttaaattttcacattcctaaggatacttttgtctcgggttgttgaatacattttaaagtgtttataataatcacttcaaaatatttaggtaattaactgtaaattatgtttcggtattctccagggacaatggccttagagctattgagaatttgatgcaaaagaaggggaaatttgattacatactgttagagaccactggattagcagaccctggtaagaagtgagattattaataaccagaatatagttctgtgatatattgtaaatagatgtattagaggaatatctaaaatgagtattaaagcttttgttagtattaaaccaaaaactttttttggttttaaag

SEQ ID NO: 10 - DNA, 6351 bp, Homo sapien
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaaccttataaaaaataaatgactatcaaaaaagaaaaaccttacattatgttctagtagttaagtttccaaggacagtgatcactagtctaccatagaccctagaagagttacccaacacatagtagcactcaaatatttgttgaatgaattataaaaatgactacttgtattgttaattttgtgtattctagtgaattaaatctcttcggcatcatttactcccttaggtatttgactttgtgtcaaatgttttggcaaggataaaattataacagactttcttgaacaaccaaaatgtaatctattaaggattttccttcacttttgataaaataagaaaaaaggaatttaaaaccttgcatcctaatgtaaaatagaattatatggtgtttaatatcagtgtccctttagctattatattaaactactatagttaataaattttatcattattttgtatgttggtttttaaaaatttcataaagctataaaaagatacttggtcagataaagtttcctctgcttttaattttaataaagtattattatgtatatgatttctttttacctattatatatatgcatctattgttttctcactggtaaatatgggacagacattttgttagaaggttagaagtgagttaaattttcacattcctaaggatacttttgtctcgggttgttgaatacattttaaagtgtttataataatcacttcaaaatatttaggtaattaactgtaaattatgttttggtattctccagggacaatggccttagagctattgagaatttgatgcaaaagaaggggaaatttgatgacatactgttagagaccactggattagcagaccctggtatcataactattgtggattcaaaatatggattaaaagtgaaataccactaaaggcagaagagaatgaaatcatcccacccactgacccgttcccaatctgagcatatggatagggcccaaagcagcaaagaattggacaacttaaaatgacagctctctattctgaggacttgacacccgggctactgacattgttcttttcagttctacaaatgtgacagcatttaatgcaatagaagcaatgaatgaagttacccagagaagcatttaacagaagagaaacctgatggccttatcaatgaagctactaggcaagttgctttggcagatatcattctcattaataaaacagacttggttccagaagaagatgtaaagaaattaagaacgacacttagatccataaatggactaggacaaatcttagaaacacaaagatcaaggctcagcagctgatagactcagcaacaggcagccaggagctctgaggctcacagctggcagtctagttccactcagtctctacttgagaaattctttctttggaagtacagcagaggccttaggtgagtggcttgtctgctatggcagagattagaggtgctgacagactgccataagtattaggcagtaacagcagcagctgcttatatgcatgtgaacagctggggaattaatttggtatgcattctcaggagccactcatctgctggcagaggtagcagaagaatgcccttagtgtaagtcctctacaaccatacaccaaatgtgctccctgcgtttcaaattccattgtagagagtctctgataatctcacttataccatgagccattcctcagtatctgtcctcttcctgttagtgttctacaattcctttctccttaatttttctccgctttacaaaatgtcacacagacaagtgcatgatacttaaacaagcttttaaaaataatgctcataaatagctttggttctgtcataatattcgtatttataaacattttaagtcaattctcttcttttattttcatttcagaaatatccatgtcctgaataaaagttgtgtcttgattagtttattatgtaacaatttagtgtgtttgacatttctaacttttatttctaacatttgctttattatagaacaataaacatgcagtgattgatttttcttacttcaagtggatgagtgagcaagtgactaaaatcttctgtgaattcttcagtgtatggtgcttgccaatgcatctgagaatctagggactttctgaaatagtacttccttgctatgaggactgaagttggattagaatccttttcaatgaagatcagatgtcctgagtagaattcttactattgggtcctgaatcttatattaaatattctctcaaattccttgagccaccgcgcccagcctgtcctctgtgattttctgggcttatgttaaaattataactcaatcaccagtctttataaatttgcttttttatatttaaaccaaacctaatgctaattgtgatatgttatttattctcacctgatttgaatcattggattcaattaaatgagtttaattatcattaaataattctaagagaaataatgtctattcggatggtgggaattttctttctacatgcagccccattctgaatgaatgaaatcaaatcacgtgacgatcagggtcctagagtaacttaatattttgtacattggttatttgactcctcatttttatattacatgttatatcaagggagggggtataaaagaaatacaaaaattgcagaggtatctggaatgtacctatttgttaattctatttgtcatttctttggtttcatcttttgagtaataagctgcttggaaaagtttctgttctttagctgattttttagctataaaaatgtatttgaaaagctcataaatttcaggattgaaaagataattgaaagtttaaaaaaaacctaattcattgaagtaataaccaaataattttcaatcttgattcaactgtgattcaaatcttacaccatttgcccacttctatgaattttatgtataaaattttttaagagtcagagtttttttttcttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaaggtacagtttactgttgcagacttttggacaaagtccttttcttggctgttataaaaactatatttggttttaaacagaaacactggttttagtacaaatcatctttgtctactttcatttttctttattattttcatgactgaaaaggagctttggaaatcactgcataaggcttgatttatttgcacaactttctttagggttgcagctagaacaaacctgtgtgctttgaaatgttaccttctgctctctgttcccaagtacagagaaataatgttgcaaatctcacttctgctgaacattatgcttcctgatgcatttagcagacactaaacatttgttgtactctaaacaaagttacaaaggactagaagaattcttgttctgtatttagaaacccactcacattacttgatatttgggtatttaagtcatgaaaggtatttcttctaggaagcagtgattctaaagtgtatgcttaaccagtcagttgagtgtctactcttgtgtgttcacaagtgtgcacaaagtttttggtaaattaagaatattatttcaaataaattaatttcatccccataggagccagtttatcagataattcgtttctcatttctgcaaatcaatacacaatgagctcatattccagataaatataatagtttttctttatttcaacattgttcattgattgcaacccatttctaaaacaaattatttaatataaccaaactcctttaacttctcaacttttcccactaaaactgtgaaacattatataaaatctttaatcaataggatatgatacatatttcatcattttgtttcaggttttggttgtgataaataacactgaaaaaccatcctaatatatgtattaactttatcattagaaaaggggattgttcaaaaaaaaatcaatacacagaaaccttttttgaaaattaaaaacattaagaaacttcttgtaattcacaaataattggaattaagtaattttctcagcttaagagtttgtattttttaagtgaatatcagtaattaatccattaacattgatgctctatttctgcttttaagtttgaactgaggctgattaatgttcagtcaattctcctttgagcaggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttaaaaaaaaaaatggcctcttggccctacggtgggtctcggcccttcctttatgggggtattcatgaccctctccttgccccgca

SEQ ID NO: 11 - DNA, 5654 bp, Homo sapien
cgcaatcagtattttcatacatatttaaaattttccatccatacaaaggttgctaacatatttatttaaaattttaaaaataattttatatgcctcttgtaaccagtaataggatgcaaagtttttttttaaggtaacattgctcctcttcccccattgtctctgtcatctatagtactccctgaggtagttcatgttattgcaagggtgtgtatcatcacaaacatattgcttccacatacatatatcagcatacatatatatatatgagcacatattaatatatgcccatgcacatacaagcatgtttttgttaatttttactgaaatggaatcatactacatacttatgaacaaattgcttctttcaccttatatcacttataattgttattctacaaatcagtacatataaaaaatacatatttacatatgtaatactctatctttctgttataattttctgcatgcacatgtatgcatatacatatattcataaacataaaacttaatctaaacgggatttttttttgggggggtgatatggtttggctgtgtccccacccaaatctcatcttgaattcccatgtgttgtggggggacccggtgggaggtaattgaattatgggggcaggtctttcctgtgctgttcttgggatagtgaaaaagtctcacaagatctgatggttttaaaaaggtgagtttccctgcataatctctcttctcctgtctggttccatgtgagatgtgccttttgccttccgccatgattgtgaggcctccccagccatgcggacccgcccataggtggaagggacttgccttgtctcggatgagactttggactttggactgtggacttttgagttaacactgaaatgaattaatgctgaaatgaattaagactttgggagacggttgagaagccatgactcattttaaaatgtgagacatgcctttcaccttctgccatgattgtgaggcctctccagccatgtggaactgtgaacacacagtgttcatcccctcaggaggacacagcttttgaggtaccatcttggaagcagagaccagccctcactagacacaaacttcctggcacgttgattttggacttcatagcctctagaactgtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaaccttataaaaaataaatgactatcaaaaaagaaaaaccttacattatgttctagtagttaagtttccaaggacagtgatcactagtctaccatagaccctagaagagttacccaacacatagtagcactcaaatatttgttgaatgaattataaaaatgactacttgtattgttaattttgtgtattctagtgaattaaatctcttcggcatcatttactcccttaggtatttgactttgtgtcaaatgttttggcaaggataaaattataacagactttcttgaacaaccaaaatgtaatctattaaggattttccttcacttttgataaaataagaaaaaaggaatttaaaaccttgcatcctaatgtaaaatagaattatatggtgtttaatatcagtgtccctttagctattatattaaactactatagttaataaattttatcattattttgtatgttggtttttaaaaatttcataaagctataaaaagatacttggtcagataaagtttcctctgcttttaattttaataaagtattattatgtatatgatttctttttacctattatatatatgcatctattgttttctcactggtaaatatgggacagacattttgttagaaggttagaagtgagttaaattttcacattcctaaggatacttttgtctcgggttgttgaatacattttaaagtgtttataataatcacttcaaaatatttaggtaattaactgtaaattatgttttggtattctccagggacaatggccttagagctattgagaatttgatgcaaaagaaggggaaatttgatgacatactgttagagaccactggattagcagaccctggtatcataactattgtggattcaaaatatggattaaaagtgaaataccactaaaggcagaagagaatgaaatcatcccacccactgacccgttcccaatctgagcatatggatagggcccaaagcagcaaagaattggacaacttaaaatgacagctctctattctgaggacttgacacccgggctactgacattgttcttttcagttctacaaatgtgacagcatttaatgcaatagaagcaatgaatgaagttacccagagaagcatttaacagaagagaaacctgatggccttatcaatgaagctactaggcaagttgctttggcagatatcattctcattaataaaacagacttggttccagaagaagatgtaaagaaattaagaacgacacttagatccataaatggactaggacaaatcttagaaacacaaagatcaaggctcagcagctgatagactcagcaacaggcagccaggagctctgaggctcacagctggcagtctagttccactcagtctctacttgagaaattctttctttggaagtacagcagaggccttaggtgagtggcttgtctgctatggcagagattagaggtgctgacagactgccataagtattaggcagtaacagcagcagctgcttatatgcatgtgaacagctggggaattaatttggtatgcattctcaggagccactcatctgctggcagaggtagcagaagaatgcccttagtgtaagtcctctacaaccatacaccaaatgtgctccctgcgtttcaaattccattgtagagagtctctgataatctcacttataccatgagccattcctcagtatctgtcctcttcctgttagtgttctacaattcctttctccttaatttttctccgctttacaaaatgtcacacagacaagtgcatgatacttaaacaagcttttaaaaataatgctcataaatagctttggttctgtcataatattcgtatttataaacattttaagtcaattctcttcttttattttcatttcagaaatatccatgtcctgaataaaagttgtgtcttgattagtttattatgtaacaatttagtgtgtttgacatttctaacttttatttctaacatttgctttattatagaacaataaacatgcagtgattgatttttcttacttcaagtggatgagtgagcaagtgactaaaatcttctgtgaattcttcagtgtatggtgcttgccaatgcatctgagaatctagggactttctgaaatagtacttccttgctatgaggactgaagttggattagaatccttttcaatgaagatcagatgtcctgagtagaattcttactattgggtcctgaatcttatattaaatattctctcaaattccttgagccaccgcgcccagcctgtcctctgtgattttctgggcttatgttaaaattataactcaatcaccagtctttataaatttgcttttttatatttaaaccaaacctaatgctaattgtgatatgttatttattctcacctgatttgaatcattggattcaattaaatgagtttaattatcattaaataattctaagagaaataatgtctattcggatggtgggaattttctttctacatgcagccccattctgaatgaatgaaatcaaatcacgtgacgatcagggtcctagagtaacttaatattttgtacattggttatttgactcctcatttttatattacatgttatatcaagggagggggtataaaagaaatacaaaaattgcagaggtatctggaatgtacctatttgttaattctatttgtcatttctttggtttcatcttttgagtaataagctgcttggaaaagtttctgttctttagctgattttttagctataaaaatgtatttgaaaagctcataaatttcaggattgaaaagataattgaaagtttaaaaaaaacctaattcattgaagtaataaccaaataattttcaatcttgattcaactgtgattcaaatcttacaccatttgcccacttctatgaattttatgtataaaattttttaagagtcagagtttttttttcttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgttacaatcacatttgacgtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttaaaaaaaaaaatggcctcttggccctacggtgggtctcggcccttcctttatgggggtattcatgaccctctccttgccccgca

SEQ ID NO: 12 - DNA, 534 bp, Homo sapien
ataaatttgatcctggctgtggtggacatggtctacgaggaacagaatcaggccaccttggaagaagcagaacagaaagaggccgaatttcagcagatgattgaacagcttaaaaagcaacaggaggcagctcaggcagcaacggcaactgcctcagaacattccagagagcccagtgcagcaggcaggctctcagacagctcatctgaagcctctaagttgagttccaagagtgctaaggaaggaagaaatcggaggaagaaaagaaaacagaaagagcagtctggtggggaagagaaagatgaggatgaattccaaaaatctgaagctggggacccacacggcagagccatggtactggaggagccattaacaaagctttcaataaacctctctttcttgaagttacctgagaatggatccattccctgcaactgaagattctaaggaactgggtttctcagtatacaatgggaatggttgggaggaggtaaagagtagaagacagtatcaagaatccagagcccagcacct

SEQ ID NO: 13 - DNA, 1457 bp, Homo sapien
  misc_feature (1024)..(1024): n=a, c, g or t
  misc_feature (1073)..(1073): n=a, c, g or t
ctgagtatgtggttgctctgaatagccatctcaaaattgaccacagaatctgttttggggtggcatagattagtctcccacacaggtcaagccagggaaccccacccagtgcctccgtccctcgttcaggcccagcctgagtgagcccaccccagtgggaggagagggcatggccagggcagggagggggtctgagtgtcctcctggctgctgaaggcaccagtcagctgccgctccagccactgccccagtggagttctttggttccaagcccacagaagaaggtggtgggtgggccagtgtgccctgaggcttcttactggggagggagagagtcaggtcctccactgttaggtggccaagcgcccaaacgccatctccactctcaccctggatgcaagaagtgaccccggaggcctgagtcctggccttggtctggtttgatgccatccaccgcagaggctgttctgagggcaggtggtcagtgcagagtggcgcgctttgtggatggcagcctccccccattactaggaatctgactgccagcccagtagccctgggctgcctgctcaggccccatcacctgtggggcaggtgctttagtccccttaagaggatgaggagggtgaggcatcagcaggcttgagcgccttgctcagggcagttccgtgggaccctgctgaacagcacgtggctgcccaacgcctgcctggagcatcccctatccccacccagcccaacccatgttctcagcagcagggatggttctaggctggctgaatgagggaccagggcagagactgcaaaagcttgagagccaagggggcagcacagagcggggagggggctgggcttgggctgtgctcctgttgggtttccattaaccaggggaccagctgggctgctgtgatttcactttcgcagaaaatgaaactgaagccgtggtcacgtgacaggacatgtagtatatagcaggctgccagcgactcctgctcttgcttctggatctgcagggcagtcgccngcaggaccccatggagtgtccttcgtgccagcatgtctccaaggggggnaacccccaagttctgcagccagtgcggagagaggctgcctcctgcagcccccatagcagattctgagaacaataactccacaatggcgtcggcctcggagggtgaaactggagtgtgggcaggagctgaaggaggaagggggcccgtgcttgttcccgggctcagacagttggcaagaaaaccccgaggagccctgttccaaagcctcctgggaccgtccaagaaggagctacatcagaggttttggtagatgctgctgtagacctcatatccgatgaatgggaagctgctaatgccatacccagcaagagaaggaagcaggatgcagccccgcttgaggccgccagcgtgccttctgcagactgtgagcagagcaaaaaaaaa

SEQ ID NO: 14 - DNA, 1527 bp, Homo sapien
  misc_feature (457)..(457): n=a, c, g or t
gcggggggggaaggtggtgggggaggaggcaaaagaggagggagaggggagggtagtgggggggggaggatttagagtggaccgctctgctcacagtctgcagaaggcacgctggcggcctcaagcggggctgcatcctgcttccttctcttgctgggtatggcattagcagcttcccattcatcggatatgaggtctacagcagcatctaccaaaacctctgatgtagctccttcttggacggtccaggaggctttggaacagggctcctcggggttttcttgccaactgtctgagcccgggaacaagcacgggcccccttcctccttcagctcctgcccacactccatttcaccctccgaggccgacgccattgtggagttattgttctcagaatctgctatgggggctgcaggaggcagcctctctccgcactggctgcagaacttgggggttnccccccttggagacatgctggcacgaaggacactccatgggtcctgctgggactgccctgcagatccagaagcaagagcaggagtcgctggcagcctgctatatactacatgtcctgtcacgtgaccacggcttcagtttcattttctgcgaaagtgaaatcacagcagcccagctggtcccctggttaatggaaacccaacaggagcacagcccaagcccagccccctccccgctctgtgctgcccccttggctctcaagcttttgcagtctctgccctggtccctcattcagccagcctagaaccatccctgctgctgagaacatgggttgggctgggtggggataggggatgctccaggcaggcgttgggcagccacgtgctgttcagcagggtcccacggaactgccctgagcaaggcgctcaagcctgctgatgcctcaccctcctcatcctcttaaggggactaaagcacctgccccacaggtgatggggcctgagcaggcagcccagggctactgggctggcagtcagattcctagtaatggggggaggctgccatccacaaagcgcgccactctgcactgaccacctgccctcagaacagcctctgcggtggatggcatcaaaccagaccaaggccaggactcaggcctccggggtcacttcttgcatccagggtgagagtggagatggcgtttgggcgcttggccacctaacagtggaggacctgactctctccctccccagtaagaagcctcagggcacactggcccacccaccaccttcttctgctggcttggaaccaaagaactccactggggcagtggctggagcggcagctgactggtgccttcagcagccaggaggacactcaggccccctccctgccctggccctgccctctcctcccactggggtgggctcactcaggctgggcctgaacgagggacggaggcactgggtggggttccctggcttgacctgtgtgggagactaatctatgccaccccaaaacagattctgtggtcaattttgagatggctattcagagcaaccacatactcag

SEQ ID NO: 15 - DNA, 601 bp, Homo sapien
ctcgtgacattgggaggaagaggctggatgctaggacggcacagtctttctgtctgaktcaccccttgttgtgctgaarctggggtycctggttccctcctacccacctggagcagaacccctaccctgctcatgttagcaggcccaatgcaggacctcggagggagaacagggtgaatctctccatgcactcgtggggaggatttctgtttttccttcctaacactcgcttctctctgagatctgacccttccttcatctgccgttacagattctgagaacaataactccacaatggcgtcggcctcggagggtgaaatggagtgtgggcaggagctgaaggaggaagggggcccgtgcttgttcccgggctcagacagttggcaagaaaaccccgaggagccctgttccaaagcctcctggaccgtccaagaagtgagtgcactgcctcggctcccctccgcccccgctcactctgcccaggaaaatctcactgcacagctgcccagctagcccccgaaaatgccaccatggcccagcccattgaacctgcccacagggcagcagcagagctgccccttctgcacctgattcatctctg

SEQ ID NO: 16 - DNA, 578 bp, Homo sapien
aacggccgcagtgtgctggaatcggctttcgagcggcgcccgggcaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacctcggccgcgaccacgctaagcc

SEQ ID NO: 17 - DNA, 745 bp, Homo sapien
ttgctgagctacatagttagagatccgttgcaagtctcagcccgctgcatcccatgacctgggctttccactcattactgtggacgtctaggatgtctgtttgcacggggctggcctcagatgagaagtcagttggaggagtctggctgtcgtcagtgtgtgggtttttgcttttcccttcctcccttcctctgccccatttactccatatctgtaccagtcgtgatcagccttctaggctagtgtctaggtctccagggttttgatggtcttaggtaggctcttgttccttctgtccctcttagactggcatcagtactatgacatagtttatatgaagcctcatgggagactccagaaagtcatgaaccacatcacagacgggccgaggaaggacctggtgaaggggaagcagattgccgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtatcaggcttgccaccagctgctctacctgctgggcaggagccacacctgacctgctagtggccggatgaccccttgactctgtgggccaggttgcaaatgggaatgtgtagaactttccagccttttctcctaccactgtctcttgggatttct

SEQ ID NO: 18 - DNA, 649 bp, Homo sapien
agtgtgctgaagcctgggaagcgtgggagaaggctctgcagcgagcagagcgggagccgaccacaggagggagaagggcaagatcctcgctccaaccgtggcccgtgttctctccttttgtccccatagtgtgactccgccaggaacttggaatggctgaagactgtgaatgagagtcatgggtctgtggaacgctcatccctgacctggccacggccatcaaccaaagaggcatctatgtgatccaggcgcccaaaggtggccaaaagatttccccagacacggttctgcacttgatccttcctgagagccctggcagccacgaggagtcacgagagtactctttagagaaagtcagcagagtttccaaacaaaaccctctgttgtgatttttcctaaacttctcttattgtacttggggaccacagaaggacactgaggacttgggactccacagccattgcttccagcgtcacccccagagggttctctgcattggggacctggcagaatgatggcgtctggtagagaggcaggcgggcggctgctcattcccctccactcctccacagatgtaagtcaagtgcccccatgtgccagctctgaaatctgatgtctcaatcacaaagacccccttggccaggccagg

SEQ ID NO: 19 - DNA, 874 bp, Homo sapien
gggaaacaaggcattccaagtacaggaaaaagcattttaaaaggctcaggaccttttggctggaacaaccatcttccagtaatttgccaaaatgacaaatacaaagggaaagaggagatgcacccaatatatgtcctctaggccttttagaaaatatggagttgttcctttggccacatggtacatgtgaatctatgagacaggtgatactgtagacatcaagggaatgggtactgttcaaaaaggaatgtcccacaaatgttaccatggcaaaactggaagagtctacggtattacccaacgtgctgttggcattgttgtaaacaaataagttacaggccagattcttgccaagagaattgtgcctattgagcacattaagcacactaagagccaatagagcttcctgaaatgtgtgaaggaaaatgatcagaaaaagaaagaagccaaagagaaaggtacctgggttcaaattaagcgccagcctgctccacccagagaagcatattttgtgagaaccagtgggaaggagcctgagctgctggaacctattccctatgaattcatggcataataggtgttaaaaaaataaaagacttctggactgttaaaaaaaaaaaaaaggttaaataattttcccaaggtcacaaagctgttgggtaaaacagcgtattgtgttttcccaagccttgccttgtttcttcattcatttttatttaacaataatttcttgagttatctaccacagactaagtgttattctaaggcacataagatttgtccatgaagaaaacagaaaaaaacacattgtggcttcatggagtttattttcccacagacaataagcaacaatttttataacagaaggaagtga

SEQ ID NO: 20 - DNA, 584 bp, Homo sapien
atggcgtgaattcacagggaataggctccagcaactcaggctccttcccactggttcttacacagtgtgcttctctgggtgtagcaggctggcgcttaatttgaacccgggtacctttctctctggcttccttcttttactaaacattttccttcacacatttcaggaagctctattggctcttagtgtgcttaatgtgctcaataggcacaattctcttggcaagaatctggcctgtaacttatttgtttacaacaatgccaacagcacgttgggtaataccgtagactcttccagttttgccatggtaacatttgtgggacattcctttttgaacagtacccattcccttgatgtctacagtatcacctgtctcatagattcacatgtaccatgtggccaaaggaacaactccatattttctaaaaggcctagaggacatatattgggtgcatctcctctttccctttgtatttgtcattttggcaaattactggaagatggttgttccagccaaaaggtcctgagccttttaaaatgctttttcctgtacttggaatgccttgtttcccggatttcgttta

SEQ ID NO: 21 - DNA, 314 bp, Homo sapien
  misc_feature (307)..(307): n=a, c, g or t
gtgccaatggcccgctatgaggaggtgagcgtgtccggcttcgaggagttccaccgggccgtggaacagcacaatgttggaaagatccaaataatgacttcagaaaaaacttgaaagtaacagcagtgcctacactacttaagtatggaacacctcaaaaactggtagaatctgagtgtcttcaggccaacctggtggaaatgttgttctctgaagattaagattttaggatggcaatcatgtcttgatgtcctgatttgttctagtatcaataaactgtatacttgctttgaattcatgttagcantaaatga

SEQ ID NO: 22 - DNA, 2528 bp, Homo sapien
gtccgggtgactatatgcttccatcaagactagtgaagaatggttgttttttccattcatccctacatttctttttttaataatgataaacatgcaacttttttgtagctttacaacaaatacccagatgctgtggccacatggctaaaccctgacccatctcagaagcagaatctcctagccccacaggtatttttaaacttctcataattaaactacagtgatgaaagatagccacactcaggccatttgggctgctcagatgaatcctgcctgcctgctggcaaacatgtgcttaggacattgactgatctgccatgttggcttctctctgtgttaagccatccacagatgaggctgaaaaataaaaactgctttggattaaaaaggttaacttttgaataaaaaagctaggcatgtgtgatgcgcactaacacgtgccattccttcttcagaatgctgtgtcctctgaagaaaccaatgactttaaacaagaggtaagttctcattttcaatcagaggcccatcatgccttgaagagatgaaagaaggcattgcctggattctcttctgatgaaatttcattagcaagttttccagctaattggcagtctaaaacttgctcataaataaaacatgtatttactaaatatcagaaatactaggtttcctcggataagtttagcattacagaagatgtttattaatgcctgttatttgaaacattaatctgcttgcaatttatttaaggtattttgtagatatctaatatctaataagcatctaattaatgcgtatcaaagctaagattttgcctttaggaaagttttctttcctaataaaatagtttatttgacaactattctttttattaggatcattcatatatttgctaagcaaagagtaaatttattttccttaagattcaatttgaatatactaagaatattaaagcaagttagataaattacccaatatatttgtcaatttgaaatttgatagacattagttgtttaattcaatgggcagttttgagctgcagtttatacacacatgcataacagagtcacctttcaattatccatgttaataggaaagtggttatagattttagtacacacattaaaatatggatactcttctcttttgataaatctcatttcaaataaaaaaaccagtctcataattatgtatctgtatctattacatcattgaatttagtaaataatgtttaatatgtataaggaaaaacaatgttattgacatgaagattatactcacatatttggcttgaaaatatctataaaaataatttctgttgcaaagtaagaaatgttcttcagaatgttattaatccctgtgttaaaagagaaattggaagatgctcactttagctcctaaaagccatggtatgtactgtgaatgcaaagattctgaaactaaataaaaagaaagatagtaaaagactaatgtgctataaaggctaagggaaaataaaaacccatatattaattttcccggccatcttaattttcagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaggcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactgatgtgtttgataattagtttagtttgtggctcatggaaactccctgtaaactaaaagcttcagggttatgtctatgttcattctatagaagaaatgcaaactatcactgtattttaatatttgt

SEQ ID NO: 23 - DNA, 3220 bp, Homo sapien
  misc_feature (2015)..(2015): n=a, c, g or t
ttaggtacaaattatgagtgtaaggaattgggttacctgctctcctgtctttccatctttttggttccccaagctaattgattgggcttcatttatgagcctgttacagtaaagtgtgtgtggggaaatatattgaggtatagagctattctttgtaggtaccctggtgagaccgatacaaatatgcccctccccataatggaatactaatttttatttgatcactcatttatagcagttgcttgaaatgtatgtatttatatgaaggtattttaatttttaagagcaaaaaagttctaataagttgccagatttctaataaatgcaggtttatttggtgaaaagataaggaaaatgagttatgattctgtagtttttttaaaatgagttcagcataattgtttttcaggtttttttagttactggggttattctgcataagaaagcccaatgctttctgatagtaggagataatttttctctcttttgactttgaaatctgacttaggagatgaattctttttaaaaaggtcagcatgcaaaaaaataaattatatattttaaattctaaaagagaagggacataaaatttcactcctagcataaagccatataatattattcttgaaactcattacatcatttgcctcctgcccatttgaatataatcatacctacgttttattaattgtgcatttgtaaaaccaaacccttccagtaaatacttgctataaggctattgcttgtcaattatcaaggcttctaaatatgttaaaacttgtcattttgatttttcaaagataattttattatactgagctaccaatattcttaaagaaaactaaccaaagttaatattagtgtagtccattattatgtggacaattattatgtggaatctcttaagtgagcaactaagaaaaagccttatagaaagactacactggatttataagtgtgtttatgtttctctaagaatgggagcttctgttaacttaggggtggagttgttctgaggaaaccagtagattggatgactgactggagaatccagaataacaaatccattagccagacatgtttacttttatattagaagtttgttgattaggtcttaattttcaaacgcaaacaccaagctttaaaaatattgcatatacaatgtattggtcagcaatttaataatatttaatttgaagttaattattgttaatccttctagaaaagttttttttctttaaataaaagtacatatatatacttttttatttagaggttaccagaagctctggttttgtttttttttgttttgtttttttgtttttttaatcattttcagatgttatccagaaatctgcaagtgtacttttcctgttttaactccttccttttatcacctgactatcagggaagcgaggttgaggctgccctgacctgacatgtcatgatgtcgacttgctaggtggggttcgctggggacgataaccagtggaattgttggtaagaacttttttttcctatttttttttatatcagtagtggggcattaagtgtgggagaatgcccatatcctataagtgggcaattatgtcagccttgtagaaaaataggactttaatattaaattattttgttcttaataggaacatataataacacttcacttacttttaaattggtagcagatcagcaggaaaggcctgcaagtatgaagtaatgaaatactcagggtatattttaagtgagcaaaatagacaccttataatcttaaaaagtctgttggagagacaataaatttgctttaactgtcatttcagtctagtattatattttctatattttgttggatagattaacatataatgcatcttaaagagatatttattgcacactaattttagtgaaaacaagaagacattgatagaatggagggcttaaacaccaaagatactatttttaaaaatcttccaaagtaatcttaacactgtaaaatgaaactttaaaaagttttagcngtttgacaataatggcctcaatttagagatatgttgagacaatgactttgggtcaagaggatattacatagctgaaatattaagaccttgaacatagcagaaacataaacctatgaacaacttgtgttttgtgtgaaagctagggtagctgataggattagcagatattggtagaattaagagtcaatatttaaattattgctaaagattaaaatccctcatcttatagtttgtaggggattccatgatggtaaggtatagattgaaattaaatttagtaactaggcatttctgaccataccatataaaaaataattgtaatatggtataaacactgattaaaagtaattatggattttcatgcctgaagaaccttctcagtattcttacagcactgtatcttctttattggttgagaatatcagtctagaaagactttcctagatgttaaatgtgctagtcagtgtcatgaatataaacccttacttgtaagtttgctatagactagttgtacaacactagaatgaaattatgtaatacttttaagaattgtagtgattgcagggttgtgttaaggtaacattttatgcatgtgtcagtgacagaaaggatcagggtataaaacttagcactaaatagcatgctccttaggaagttttaaggtaagcagtaggaatattcatgtaattctgatgagtttatgtaagttaaggaaaatgcaatgccagtttgttgactttaaacactaaaaacaaaatacattttgtggaaccaacaaaggagacattctggggaaaaacttaaattgctcaaatttaaataagggctctcactttatatagtagatttgtcaggatcccatgaacattgcttttcttgatttctcacatatgagggttgggcaaaagggacttctctagcctcttcgataatgtaggtagacttgtacttagtgaatcccattataatgttaggtactatgttctaagactatttctataattggactgaaggctcctgcaaacataaattgctgatatggatatagtaacataagaaataccaaaatagggacatttgcaagaccttttccatttaatcatcagtttaataaaaatcatgcttttggtacagtgttcatgtaccataactgtattggaatatttgtacgatgttaaatatttttaataaaatttaacatgttc

SEQ ID NO: 24 - DNA, 3224 bp, Homo sapien
ttaggtacaaattatgagtgtaaggaattgggttacctgctctcctgtctttccatctttttggttccccaagctaattgattgggcttcatttatgagcctgttacagtaaagtgtgtgtggggaaatatattgaggtatagagctattctttgtaggtaccctggtgagaccgatacaaatatgcccctccccataatggaatactaatttttatttgatcactcatttatagcagttgcttgaaatgtatgtatttatatgaaggtattttaatttttaagagcaaaaaagttctaataagttgccagatttctaataaatgcaggtttatttggtgaaaagataaggaaaatgagttatgattctgtagtttttttaaaatgagttcagcataattgtttttcaggtttttttagttactggggttattctgcataagaaagcccaatgctttctgatagtaggagataatttttctctcttttgactttgaaatctgacttaggagatgaattctttttaaaaaggtcagcatgcaaaaaaataaattatatattttaaattctaaaagagaagggacataaaatttcactcctagcataaagccatataatattattcttgaaactcattacatcatttgcctcctgcccatttgaatataatcatacctacgttttattaattgtgcatttgtaaaaccaaacccttccagtaaatacttgctataaggctattgcttgtcaattatcaaggcttctaaatatgttaaaacttgtcattttgatttttcaaagataattttattatactgagctaccaatattcttaaagaaaactaaccaaagttaatattagtgtagtccattattatgtggacaattattatgtggaatctcttaagtgagcaactaagaaaaagccttatagaaagactacactggatttataagtgtgtttatgtttctctaagaatgggagcttctgttaacttaggggtggagttgttctgaggaaaccagtagattggatgactgactggagaatccagaataacaaatccattagccagacatgtttacttttatattagaagtttgttgattaggtcttaattttcaaacgcaaacaccaagctttaaaaatattgcatatacaatgtattggtcagcaatttaataatatttaatttgaagttaattattgttaatccttctagaaaagttttttttctttaaataaaagtacatatatatacttttttatttagaggttaccagaagctctggttttgttttgttttgttttgtttttttgtttttttaatcattttcagatgttatccagaaatctgcaagtgtacttttcctgttttaactccttccttttatcacctgactatcagggaagcgaggttgaggctgccctgacctgacatgtcatgatgtcgacttgctaggtggggttcgctggggacgataaccagtggaattgttggtaagaacttttttttcctatttttttttttatcagtagtggggcattaagtgtgggagaatgcccatatcctataagtgggcaattatgtcagccttgtagaaaaataggactttaatattaaattattttgttcttaataggaacatataataacacttcacttacttttaaattggtagcagatcagcaggaaaggcctgcaagtatgaagtaatgaaatactcagggtatattttaagtgagcaaaatagacaccttataatcttaaaaagtctgttggagagacaataaatttgctttaactgtcatttcagtctagtactatattttctatattttgttggatagattaacatataatgcatcttaaagagatatttattgcacactaattttagtgaaaacaagaagacattgatagaatggagggcttaaacaccaaagatactatttttaaaaatcttccaaagtaatcttaacactgtaaaatgaaactttaaaaagttttagcagtttgacaataatggcctcaatttagagatatgttgagacaatgactttgggtcaagaggaaattacatagctgaaatattaagaccttgaacatagcagaaacataaacctatgaacaacttgtgttttgtgtgaaagctagggtagctgataggattagcagatattggtagaattaagtcaatatttaaattattgctaaagattaaaatccctcatcttatagtttgtaggggattccatgatggtaaggtatagattgaaattaaatttagtaactaggcatttctgaccataccatataaaaaataattgtaatatggtataaacactgattaaaagtaattatggattttcatgcctgaagaaccttctcagtattcttacagcactgtatcttctttattggttgagaatatcagtctagaaagactttcctagatgttaaatgtgctagtcagtgtcatgaatataaacccttacttgtaagtttgctatagactagttgtacaacactagaatgaaattatgtaatacttttaagaattgtagtgattgcagggttgtgttaaggtaacattttatgcatgtgtcagtgacagaaaggatcagggtataaaacttagcactaaatagcatgctccttaggaagttttaaggtaagcagtaggaatattcatgtaattctgatgagtttatgtaagttaaggaaaatgcaatgccagtttgttgactttaaacactaaaaacaaaatacattttgtggaaccaacaaaggagacattctggggaaaaacttaaattgctcaaatttaaataagggctctcactttatatagtagatttgtcaggatcccatgaacattgcttttcttgatttctcacatatgagggttgggcaaaagggacttctctagcctcttcgataatgtaggtagacttgtacttagtgaatcccattataatgttaggtactatgttctaagactatttctataattggactgaaggctcctgcaaacataaattgctgatatggatatagtaacataagaaataccaaaatagggacatttgcaagaccttttccatttaatcatcagtttaataaaaatcatgcttttggtacagtgttcatgtaccataactgtattggaatatttgtacgatgttaaatatttttaataaaatttaacatgttcaaaaaa

SEQ ID NO: 25 - DNA, 1851 bp, Homo sapien
gggcggggccacctcccggtgcggggccggggcctgatgggcgtggtcagctcctggggcggggacgtgaggggcggggtcagctcctaggggggcatggggcgtgaggggcgcggtcagttccctggttgtggacatgaagggcggggccagctcctggggcggggtcgtgaggggcgtggtcagctcctggggcggggatgtgaggggcggggtcatctcctggggcggggatgtgaggggcgtggtcagctcctggggcggagatgtgaggggcggggtcatctcctggggcggggattgaggggcgggggtcagttcctggggcggggcgtgaggggcgtggctgctcgggggattgggcgtgggggcggggccgggttggagaccggaggagtagacggcagaggcgcccccgcaggtaggcgcaggtgggtccggagggtcctggccgacgcgggtgggggtcgctcgccgcagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggaggtgatggctgccccaccagcgtcagaggcaaaggccaggcctgggcgtgactacccatgcacaagtgttagggacagagagacccttcctccagggggttggatcctctctggagcccaccattgtcttgtcaggccccttccctgccctctggagttttccccacataagcagccccccaaggcccctccatatgcctcctcccaattctcctccccaggacccaggggtttcctcactcccacctggggaatggctcccacggggaaacctcttcacttccggttctggcagcgacttctgcggctgcaccaggaatcctggttttctgagcctggctcccccagattctggtttggggacagggttcacaggctgtgcaggcgagagcagggcactggctggagagcagccgggtgggggagcatcccgggccagccgaggggctgagtgcccccaaagcccacaggtgcaccccttccctgaagcagaggtgaggtttggggggctgagtccccgacagggttgtctcttgggttcccagactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcaaccctgcccactcgggcttcatcctgcacaataaactccggaagcaagtcagtagagctggctcctggctgtctgcgctgtcatcacccgtcctgggcctggccctggccacccggacctccccctctaaaatctcagcctgacgtcaacaaagga

SEQ ID NO: 26 - DNA, 954 bp, Homo sapien
gcggcggcacagctcccgcagctcctgctctggtccgcctcggcccggacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggaggtgactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 27 - DNA, 1519 bp, Homo sapien
gcggcggcacagctcccgcagctcctgctctggtccgcctcggcccggacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaaggtgaggggctttcctgcgtcatccccaagggctacaggaccctgtcaggggaagggcactttccggctgggtcttccccctgggaggagtgagcgaagtcccgcagtgccgggcagtgccggccagggactgagcgggcgcgcaggaaggaggctgggtagccgcccgaggaggctgcccgcgagaagccctccctgggcaccgcgtcccgtctcccctgatgggccacgcagacaccgggccacacacgcgcccacgccagccagacacgtccacccctgtgggcacgcgacccccagaggacacacgagcgcacgttccacacctgggtgccaggacacgggcgggtggggcacagggatggcgacaaacactccgtgcgcggtgggggttgggagggacgcgcaccgcacagacagccggcgacgcgcgctctcgcccgggagctgctcggggaagcgccggagcgcgggtccccgcgccgcgcgcccctccctggcgtcgaggagaaccccagcggtccgcagagctgagccgaagacccgccccgatccccgccaggaatgcgacgtcctctgccgcccgctgtatgggccaggcgctcagccagggcacagaatcgggaccgggggcggaggggccgaagctggctggtgggcggcgtgcgaggttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 28 - DNA, 2459 bp, Homo sapien
gcggcggcacagctcccgcagctcctgctctggtccgcctcggcccggacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaaggtgaggggctttcctgcgtcatccccaagggctacaggaccctgtcaggggaagggcactttccggctgggtcttccccctgggaggagtgagcgaagtcccgcagtgccgggcagtgccggccagggactgagcgggcgcgcaggaaggaggctgggtagccgcccgaggaggctgcccgcgagaagccctccctgggcaccgcgtcccgtctcccctgatgggccacgcagacaccgggccacacacgcgcccacgccagccagacacgtccacccctgtgggcacgcgacccccagaggacacacgagcgcacgttccacacctgggtgccaggacacgggcgggtggggcacagggatggcgacaaacactccgtgcgcggtgggggttgggagggacgcgcaccgcacagacagccggcgacgcgcgctctcgcccgggagctgctcggggaagcgccggagcgcgggtccccgcgccgcgcgcccctccctggcgtcgaggagaaccccagcggtccgcagagctgagccgaagacccgccccgatccccgccaggaatgcgacgtcctctgccgcccgctgtatgggccaggcgctcagccagggcacagaatcgggaccgggggcggaggggccgaagctggctggtgggcggcgtgcgagggtgagggactgtcctcgggaggggcgtggccagacgggggtgctgggtgtcaggggcgtggccagctcctggggcggagatgtgaggggcggggtcatctcctggggcggggattgaggggcgggggtcagttcctggggcggggcgtgaggggcgtggctgctcgggggattgggcgtgggggcggggccgggttggagaccggaggagtagacggcagaggcgcccccgcaggtaggcgcaggtgggtccggagggtcctggccgacgcgggtgggggtcgctcgccgcagtttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggaggtgatggctgccccaccagcgtcagaggcaaaggccaggcctgggcgtgactacccatgcacaagtgttagggacagagagacccttcctccagggggttggatcctctctggagcccaccattgtcttgtcaggccccttccctgccctctggagttttccccacataagcagccccccaaggcccctccatatgcctcctcccaattctcctccccaggacccaggggtttcctcactcccacctggggaatggctcccacggggaaacctcttcacttccggttctggcagcgacttctgcggctgcaccaggaatcctggttttctgagcctggctcccccagattctggtttggggacagggttcacaggctgtgcaggcgagagcagggcactggctggagagcagccgggtgggggagcatcccgggccagccgaggggctgagtgcccccaaagcccacaggtgcaccccttccctgaagcagaggtgaggtttggggggctgagtccccgacagggttgtctcttgggttcccagactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 29 - DNA, 575 bp, Homo sapien
caatggcagccggcccaatggcagccgtagccgtgcgggccgcacgcgttagtcgccctggccggcctcgtcacagggatacccacccaccatcccagggtctacaacatccacagccggaccgtcacccgctatcctgccaactctatcgtggtcgtaggaggctgtcctgtctgcagggttggggtgctggaggactgcttcaccttcctgggcatcttcctggccatcatcctcttccgcattgggccggctgccattgggcaatggcagccgcccaatggcagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 30 - DNA, 638 bp, Homo sapien
ccgccctgctcgaggcctgggccagggacagaggggtgagtgttcaagtcagaacctccctcccgcagccccttcatgaggagccccctccatgggggacatggagaccaggcgcccactctgtgccaggccccagcagctcccaggatgtggggcttcagcctggtggggggcatagggtagagggtgcccatgggggatacaggggaaccaaccatactgggctcaggcacagcctcctaggggtggacagcctgctcttggcagaggtggagaaagaccctctctttgtttccagtgcccagggagaggtgggaggtgatgggggatctgtgcagtttgggggctcagtcaagacgagctctgcgttacgggaggaacaggaagcccagtgggaaaattggcctaagtctggggttctgacgacagcccctggcttctttcttggcagataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 31 - DNA, 745 bp, Homo sapien
  misc_feature (718)..(718): n=a, c, g or t
gcggcggcacagctcccgcagctcctgctctggtccgcctcggcccggacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgwtaagtgcatgacggracawtaggaytycccagggttkwagttgggttccggccancagtgaccccaggtttggtgtttttgt

SEQ ID NO: 32 - DNA, 2528 bp, Homo sapien; identical to SEQ ID NO: 22

SEQ ID NO: 33 - DNA, 917 bp, Homo sapien
agcggcgcagtgtgatggatgtcgcggccgaggtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagcyaatgatgagagcaatgagcattccgatgtgattgatagtcaggaactttccaaagtcagccgtgaattccacagccatgaatttcacagccatgaagatatgctggttgtagacccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagcggtaaatccatgggcccattagcctgtttttccctggttgtggaaaattggtttaatccgctccaacaaattccacccatttcggacgccgaacaaacacacttagggttaccgcctgggggccacagcaatagaaacacccccaatatgctgacaaaggcccaccattcgacagagaaaaaatccacgatgataaaaacagcaacccgagagaaagcggtagaaaaccgcgaacagccacgcccagaatagcacacttcctggcgagaagaaaa

SEQ ID NO: 34 - DNA, 482 bp, Homo sapien
ctttcctaatcagtactcctgatgctgctgaggaagagtcgaactatagaggtcacacattgttttccttgtttttggatgcagttttgttttctgtgataatcataaattgaggatttatgacagccgatttctctctgttattttggtcacaatttcacaatgtgacctttggaagtaagggctttgagttccttaaaatagctaaattgagaggataaaggaaaactgactcaaatcagagaatttgcatcaggtttctgtaggtttcttataataatcaacaagtatttagcaattcttttttcacataaatagaagagcccaagagaagaacagcgtctttgacctgatggtgttaagcctgcaatctgggtaaaaaggaatttgcggaacactctggatctgatactgaaaagttgaagaaagcaacatcttgcttattacccttgtgtttaagaccatttggggccgggcgcggt

SEQ ID NO: 35 - DNA, 483 bp, Homo sapien
ctttcctaatcagtactccctgatgctgctgaggaagagtcgaacttatagaggtcacacattgttttccttgtttttggatgcagttttgttttctttgataatcataaattgaggatttatgacagccgatttctctctgttattttggtcacaatttcacaatgtgacctttggaagtaagggctttgagttccttaaaatagctaaattgagaggataaaggaaaactgactcaaatcagagaatttgcatcaggtttctgtaggtttcttataataatcaacaagtatttagcaattcttttttcacataaatagaagagccaagagaagaacagcgtctttgacctgatggtgttaagcctgcaatctgggtaaaaaggaatttgcggaacactctggatctgatactgaaaagttgaagaaagcaacatcttgcttattacccttgtgtttaagaccatttggggccgggcgcggt

SEQ ID NO: 36 - DNA, 1853 bp, Homo sapien
  misc_feature (502)..(502): n=a, c, g or t
gtcatcgatgtcatccacgaggtggcccacagttggttcggcaacgctgtcaccaacgccacgtgggaagagatgtggctgagcgagggcctggccaccttatgcccagcgccgtatcaccaccgagacctacggtgctgccttcacctgcctggagactgccttccgcctggacgccctgcaccggcagtcgagtacctacccgaaacgaccgcgggcgagcggggctttggtacgccggtggagacgcaggcgaggactccagcgggaggaagaagaggcctttgccagcagtcagagcagccaaggggcccaatccctcatattctccaagtttgaaggaaagaaaaccaacaagaagacccgcaaggttaccacagtgaagaaatcttcagtacgtcttccagggctcggatcaaagaaggatattgaaatggattccaggcgtgtgcctcgagacaagctggcctgcatcaccaagtgcagcaagcacatcttgcgntgccatcaagatcacctagaacgagctggcgtcagcagatgacttccctccccaccctcatctacattgttttgaagggcaacccccatgccttcagtctaatatccagtatatcacgcgcttctgcaatccaagccgacggcatgactggagaggatggctactatttcaccaatctggtgagtaaagtgagttcttggcgttgtggagaacggactaggaaggtggtggttttggggatgtgataggtcactcaggccccatgacaggtgaatgcttctgtgtgagaaggcagcacggctgaggaagctcactttgcatcagggagcacaaggacccaggccgtacagacactccgcctcccagcacttgatcagagattgtgtttatcctacagaaacagatgacatgtgttgggcatcactcccccacggtcctgggtaggaaagaggtccttccacttggcagggctttttcaaccaatgaataaggcaaattatatataaggtaattaatgcccatttcgaaccgagacagatggcagctagaatgaagctttaatgtaagagtaaagtagaagcaatgagtgctggggccctttttattgggtactggcattctactttcgaccacaaaagacgaagtgaccccaactttcaaggaacaggctgttgagatggaaggaaagaaacaggagctttgctcaaggaggagagctgggctttcccaagttacctgaccttaaagatgctgaagctgttccagaagtttctttccttgaaggaaatacagcttggtgaagagttactagctgcaaggtgaatatgagaaggggcgtagacccatctgacaaatgggaattgctgtgtgtggacagcccacagccagtttactgcagggccttacagcaaactcttcccaccactagtgttcccagatgcttttgactaagctcccaacaattagagaattctaagtgctcagagcttggctgaagatgatgtggaatgagaaacaaatgttaacataataaaatctcagttaaaaatatttaaaaaattcttggtagcttgagcagctctgggggaataagggcaaatatgcttgttatgaactacactgaaatctaccaaagttaatgtttactttgtgtagatccatttgtctattttatttatttttcccagtgaaaagtgtattttgatagagaacttttcattcatataaatacactatgagttactgaaaattcatatcatggatttcatttattcctgaaacatagttaaaatgtacatatgacatggcttatgttaaaaatacccagtgctcaagttttgaaagataggca

SEQ ID NO: 37 - DNA, 2184 bp, Homo sapien
aggcagacgggaacctgagactttgtccaaacctcggctggaaggctggtcttggcactcggcgtcttagctagtggatttatcgcattaagactgtacttgggcctttttcatgatgacttgggtctcaatccttggagcagctgaaagaacagctcgggccacctgtggatgcacccacaatgaaatcagaggccacgtgaggtttgcaaggcagagtggcctgcagttttaactcgggcactatggcaatgcagacccaaaccaattgtgccagttctttgctgggtggcaaagtgttttcaggcttgtggtcactcctgatttctgtttggaagcacagttctctctctaaggagaatggaaacttggaaaggcctgtaaaatcggaaagcctgtaaaaggccgtagagtggagatgtataaaaatgtacggtcacccatgttttaggggttgaccgggagcggggcgaggaggagggtgggtatgaggcggtagcggaccgcggagtcgagacctacccgaacgacgcgggcgagcggggctttggacgccggtggagacgcaggcgagggctgctgtaaaatattacaggcatactttggagatgttatgggtttggttccacatcactgcaataaaactccagcgggaggaagaagaggcctttgccagcagtcagagcagccaaggggcccaatccctcatattctccaagtttgaaggaaagaaaaccaacaagaagacccgcaaggttaccacagtgaagaaatcttcagtacgtcttccagggtcggatcaaagaaggatattgaaatggattccaggcgtgtgcctcgagacaagctggcctgcatcaccaagtgcagcaagcacatcttcgatgccatcaagatcacctagaacgagctggcgtcagcagatgacttcctccccaccctcatctacattgttttgaagggcaacccccatgccttcagtctaatatccagtatatcacgcgcttctgcaatccaagccgactgatgactggagaggatggctactatttcaccaatctggtgagtaagtgagttcttggcgttgtggagaaggactaggaaggtggtggttttggggatgtgataggtcactcaggcccatgacaggtgaatgcttctgtgtgagaaggcagcacggctgaggaagctcactttgcatcagggagcacaaggaccaggccgtacagacactccgcctccccgcacttgatcagagattgtgtttatcctacagaaacagatgacatgtgttgggcatcactccccacggtcctgggtagaagagtccttcacttggcagggctttttcaaccaatgaataaggcaaattatatataagttaataatgccatttcgaaccgagacagatggcagctaaatgaagtttaattaaagaatgagcgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatggaattgctgtgtgtggacagccacagcagttactgcaggccttacagcaaactcttccaccactagtgttccagatgcttttgactaagctcccaacaattagagaattctaagtgctcagagcttggctgaagatgatgtggaatgagaaacaaatgttaacataataaaatctcagttaaaaatatttaaaaaattcttggtagttgagcagctctgggggaataagggcaaatatccttgttatgaactacactgaaatctaccaaagttaatgtttactttgtgtaggtccatttgtctattttatttatttttcccagtgaaaagtgtattttgatagagaacttttcattttataaatacactatgagttactgaaaattcatatcatggatttcatttattcctgaaacatagttaaaatgtacatatgacatggcttatgttaaaaatacccagtgctcagttttgaaagataggcacaaaaa

SEQ ID NO: 38 - DNA, 906 bp, Homo sapien
agtaggtggggttacaggcacgcgccacctttggatccacacctcctcccgtcctgagccaaaggccacggaagtgacgtttgcacgccgtgcgtaacgtgcattctggcggtgccgggagcggggcgaggaggagggtgggtatgaggcggtagcggaccgcggagtcgagacctacccgaacgacgcgggcgagcggggctttggacgccggtggagacgcaggcgagactccagcgggaggaagaagaggcctttgccagcagtcagagcagccaaggggcccaatccctcatattctccaagtttgaaggaaagaaaaccaacaagaagacccgcaaggttaccacagtgaagaaatcttcagtacgtcttccagggtcggatcaaagaaggctgaaattcaggaagcaaaagctcccagtccttccataaaccggcaaaccagcattgaaatggatagagtgtctaaggagttcatagaatttctcaagaccttctgcaagacaggccaagaaatctataaactgaccaagctgtttttggaagggatgcattacaaaactctatgtttctatgtgattattctcaacctacccttttgtaatgcatcccttccaaaagggtaggttgagaataatcacatagaaacatagagttttggtttgaggaaaggtcttagagataatatagtgcaaccttgtcattttatgcctgagaaaatcaagaccaagagatgttaaattacttacctaagaaaagcctctgaatcaagctaaaagccaactcttaggctagtacttttccactgcaactcagtggtgtttgaatcatctttgtgtggaaattctgaccttgaagccacttgaattatgtgctttagtacaggcctaaaagacttgtgac

SEQ ID NO: 39 - DNA, 2318 bp, Homo sapien
agtaggtggggttacaggcacgcgccacctttggatccacacctcctcccgtcctgagccaaaggccacggaagtgacgtttgcacgccgtgcgtaacgtgcattctggcggtgccgggagcggggcgaggaggagggtgggtatgaggcggtagcggaccgcggagtcgagacctacccgaacgacgcgggcgagcggggctttggacgccggtggagacgcaggcgagactccagcgggaggaagaagaggcctttgccagcagtcagagcagccaaggggcccaatccctcatattctccaagtttgaaggaaagaaaaccaacaagaagacccgcaaggttaccacagtgaagaaatcttcagtacgtcttccagggtcggatcaaagaaggatattgaaatggattccaggcgtgtgcctcgagacaagctggcctgcatcaccaagtgcagcaagcacatcttcgatgccatcaagatcacctagaacgagctggcgtcagcagatgacttcctccccaccctcatctacattgttttgaagggcaacccccatgccttcagtctaatatccagtatatcacgcgcttctgcaatccaagccgactgatgactggagaggatggctactatttcaccaatctggtgagtaagtgagttcttggcgttgtggagaaggactaggaaggtggtggttttggggatgtgataggtcactcaggcccatgacaggtgaatgcttctgtgtgagaaggcagcacggctgaggaagctcactttgcatcagggagcacaaggaccaggccgtacagacactccgcctccccgcacttgatcagagattgtgtttatcctacagaaacagatgacatgtgttgggcatcactccccacggtcctgggtagaagagtccttcacttggcagggctttttcaaccaatgaataaggcaaattatatataagttaataatgccatttcgaaccgagacagatggcagctaaatgaagtttaattaaagaatgagcgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggtgaagagttactagctcaagaggctgggcactcactgcagctggctaatgatgaccatgtggacatgctttcgggccttcaggatcttctccagccagtggatgtcgtacgtgttggggttccggaaagggatgtcaggtggtggctcacacctgcgatcccagcactttgggaggccaaggcgggtggatcgcttgagcccagaagatcaagaccagtctgggcaacatggtgaaacctcgtctctactaaaaatagaaaaattagccgggagtggtggcgcacgcttgtagtcccagctacttgagaggctggggcaggaggattgcctaagcccatgaggtggaggctgcagtgagcagacattgcaccactgtactccagcctgggcaacagagtgagacgctgtttaaaaaaaaaaaaagaaaatcaacatacacaaaatgtgggtcatgggcagagcagccatgtccccagggagcaggcaggccagctgggggctcctgaaggctaggctggctgcagagggagggagggcctccccctttccccgggaggagggcttggtgtgctgaccctgaccacagacactgactgtatttctcgttgaagagttccttcacctgctcctgcaggatcacctccccaagtctgttggtatcatcttcatctaaagaggaagacaagggggcctgagagttggcactggcttggccaccagacctgctgcttctcccaccaggcatccctgacctgccaaaacattctctgcaggccctgcctactcccattgctggagtgcagaggcgcgatctcagcttactgcaacctccacctcccaggttcaagtgattctcctgcgtcagccccccaagtagctggaatcacaggcaccgcaccaccatgcctagctaatttttgtattttttagtagagacgggttttcatcatgttgctcaggctggtctcaaactcttgggctcaggtgatccacccgccttggcctcccaaagtgttgggattacaggcgtgagccactgtgcctggctgtagctggtttctagccccagttgttggtctgtccatccatccat

SEQ ID NO: 40 - DNA, 1017 bp, Homo sapien
  misc_feature (418)..(418): n=a, c, g or t
  misc_feature (422)..(422): n=a, c, g or t
  misc_feature (826)..(826): n=a, c, g or t
gctccggctgggcagcagcgctctgcgcagcctcgcgctcatctggctccggggtgagtgcagagcagggtgagggtagaagaagtaggatcctcaatacaagctcattaaagagagggaaggagggaggaggcaagaaccccctatactggaaaacaaacaacccaaggaaattgacgtggtccgagcccattttcaaagtaaggaagtataatggagatttcgctactcttctgtatgggaaggactgatggcagctagaactttagtttgtggtatgaagtgctttaaaagaaacacttggatgaaaaggaaattccttgaatgttaattgtgactgtaaacgtgttaaaactagccaaagaggacgcactggtgtcggtctctgcctttcttacctctttggataaaacccatnaggncaccaaaatcctggctgtttacatttctgcagatttgggaattacccatctgctaaatcatttgtcttttattttcttttcaaaggctaaaactgtatcgaagtctaaccctgtatttcctcctagtaaacacaatagatgttaaaagggaattcttttcccaaaaataaccttttattattacaaaagccaaacataatcatttgagatataaaatcctggcaaacataatcgtggttaaaatttaatctgggccctttgggatctgtcccttcaaaggcaggtgagttgccctttaattcgtattgccacttcattgactcaatcactgttatttcagaaaaaaataaaaggaagtagcagaattcaagttacgcaaaacaaaacttgctgtctaacaagcnctctttgaaagcaaagatgttttagtgttcagcttttaaattgagctatgtgattaaaaccaaccatgaccttaacggattttacccaaactcgtctaacttcagtatgttttgtcagagattaatcagttacttgttcaaacttaaattgagatagtgtaaatatcagggtttcctagataaggacagaa

SEQ ID NO: 41 - DNA, 1079 bp, Homo sapien
ttttttcttgcagaatgcagtgggccagccggctcgcggacttgaaaccaggctgttgcgagcccagagctccggctgggcagcagcgctctgcgcagcctcgcgctcatctggctccggggtgagtgcagagcagggtgagggtagaagaagtaggatcctcaatacaagctcattaaagagagggaaggagggaggaggcaagaaccccctatactggaaaacaaacaacccaaggaaattgacgtggtccgagcccattttcaaagtaaggaagtataatggagatttcgctactcttctgtatgggaaggactgatggcagctagaactttagtttgtggtatgaagtgctttaaaagaaacacttggatgaaaaggaaattccttgaatgttaattgtgactgtaaacgtgttaaaactagccaaagaggacgcactggtgtcggtctctgcctttcttacctctttgataaaacccataggcaccaaaatcctggctgtttacatttctgcagatttgggaattacccatctgctaaatcatttgtcttttattttctttcaaaggctaaactgtatcgaagtctaaccctgtatttcctcctagtaaacacaatagatgttaaaagggaattcttttcccaaaataaccttttattattacaaaagccaaacataatcatttgagatataaaatcctggcaaacataatcgtggttaaaatttaatctgggccctttgggatctgtcccttcaaaggcaggtgagttgccctttaattcgtattgccacttcattgactcaatcactgttatttcagaaaaaaataaaaggaagtagcagaattcaagttacgcaaaacaaaacttgctgtctaacaagcactctttgaaagcaaagatgttttagtgttcagcttttaaattgagctatgtgattaaaaccaaccatgaccttaacggattttacccaaactcgtctaacttcagtatgttttgtcagagattaatcagttacttgttcaaacttaaattgagatagtgtaaatatcagggtttcctagataaggacagaa

SEQ ID NO: 42 - DNA, 1076 bp, Homo sapien
ttttttcttgcagaatgcagtgggccagccggctcgcggacttgaaaccaggctgttgcgagcccagagctccggctgggcagcagcgctctgcgcagcctcgcgctcatctggctccggggtgagtgcagagcagggtgagggtagaagaagtaggatcctcaatacaagctcattaaagagagggaaggagggaggaggcaagaaccccctatactggaaaacaaacaacccaaggaaattgacgtggtccgagcccattttcaaagtaaggaagtataatggagatttcgctactcttctgtatgggaaggactgatggcagctagaactttagtttgtggtatgaagtgctttaaaagaaacacttggatgaaaaggaaattccttgaatgttaattgtgactgtaaacgtgttaaaactagccaaagaggacgcactggtgtcggtctctgcctttcttacctctttgataaaacccataggcaccaaaatcctggctgtttacatttctgcagatttgggaattacccatctgctaaatcatttgtcttttattttctttcaaaggctaaactgtatcgaagtctaaccctgtatttcctcctagtaaacacaatagatgttaaaagggaattcttttcccaaaataaccttttattattacaaaagccaaacataatcatttgagatataaaatcctggcaaacataatcgtggttaaaatttaatctgggccctttgggatctgtcccttcaaaggcaggtgagttgccctttaattcgtattgccacttcattgactcaatcactgttatttcagaaaaaaataaaaggaagtagcagaattcaagttacgcaaaacaaaacttgctgtctaacaagcactctttgaaagcaaagatgttttagtgttcagcttttaaattgagctatgtgattaaaaccaaccatgaccttaacggattttacccaaactcgtctaacttcagtatgttttgtcagagattaatcagttacttgttcaaacttaaattgagatagtgtaaatatcagggtttcctagataaggaca

SEQ ID NO: 43 - DNA, 2206 bp, Homo sapien
  misc_feature (1423)..(1725): n=a, c, g or t
ggagagcgcgccgcggccctttatagcgcgcggggcaccggctccccaagactgcgagctccccgcaccccctcgcactccctctggccggcccaggggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgtgtcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggactgaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgttaaaaaa

SEQ ID NO: 44 - DNA, 2939 bp, Homo sapien
gggaggagcggcgggggcgggcgccgggggcgggcagaggcgcgggagagcgcgccgccggccctttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggtttgggtagaggcaatccaaaagggctggattgctgcttagattggagcaggtacaacgttgtgcatgccccgtatttctacgaggtgttcgggacggcgtagagactgggacctgctgcgtactggcaaagcagaccttcataagaaataatcctgatccaatacagccgacggtgtgacaggccacacgtccccgtgggtctctgtggaagtttcagtgtagcgacatttcagataaaagtggaaaaagtgaagtttggcttttttcatttgtatgcagtcctaactcttgtcacacgtgtgggatttatctttttccataacttactgaaaacccttcctggcgggctgaacctgactcttcctgagctgagtcctggactggcacactgatggctctgggctcttcccggtcaagttataacaaggctttgcccatgaataatttcaaacgaaaatgtcaagatccttgccggtgtcctgggattacaaggtgaatcttgtcatgaagaaattctaggtctagaaaaaatttgaagattctttttctcttgataattcactaatgaagcttttgtggttgaaaaataaaaagtgaggtttatggtgatgtcaggtgggaaggtgttttatacatcaatacattcgagtgctctgaagtgcatgtaataatagctgtttctctgttgtttaaaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacaccaagctaatttttgtattttttagtagagatggggtttcaccatcttggccaggctggtcttgaattcctgacctcagttgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgt

SEQ ID NO: 45 - DNA, 2242 bp, Homo sapien
gggaggagcggcgggggcgggcgccgggggcgggcagaggcgcgggagagcgcgccgccggccctttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggtgagtggcaccagcccctggaagcccggggcgcgccacacgcaggagggaggcgacagtcctggctggcagcgggctcgccctggttccccggggcgcccatgttgtcccccgcgcctacgggactcggctgcgctcacccagcccggcttgaatgaaccgagtccgtcgggcgccggcgggagttgcagggagggagttggcgccccagaccccgctgccccttccgctggagagttttgctcggggtgtccgagtaattggactgttgttgcataagcggacttttagctcccgctttaactctggggaaagggcttcccagtgagttgcgaccttcaatatgataggacttgtgcctgcgtctgcacgtgttggcgtgcagaggtttggatattatctttcattatatgtgcatcttcccttaataaagagcgtccctggtcttttcctggccatctttgttctaggtttgggtagaggcaatccaaaagggctggattgctgcttagattggagcaggtacaacgttgtgcatgccccgtatttctacgaggtgttcgggacggcgtagagactgggacctgctgcgtactggcaaagcagaccttcataagaaataatcctgatccaatacagccgacggtgtgacaggccacacgtccccgtgggtctctgtggaagtttcagtgtagcgacatttcagataaaagtggaaaaagtgaagtttggcttttttcatttgtatgcagtcctaactcttgtcacacgtgtgggatttatctttttccataacttactgaaaacccttcctggcgggctgaacctgactcttcctgagctgagtcctggactggcacactgatggctctgggctcttcccggtcaagttataacaaggctttgcccatgaataatttcaaacgaaaatgtcaagatccttgccggtgtcctgggattacaaggtgaatcttgtcatgaagaaattctaggtctagaaaaaatttgaagattctttttctcttgataattcactaatgaagcttttgtggttgaaaaataaaaagtgaggtttatggtgatgtcaggtgggaaggtgttttatacatcaatacattcgagtgctctgaagtgcatgtaataatagctgtttctctgttgtttaaaggcactacaaatactgtggcagcatataatttaacttggaaatcaactaatttcaagacaattttggagtgggaacccaaacccgtcaatcaagtctacactgttcaaataaggtaagctgggtacagaaaaagaaaattaaggtctttgatgtttctactgtcctatgctgaacaagaatgtctttaaagctgattactggatgaaattatttaacagatgacgaagaagaagggattcttggcaattcgctggccggtgtcatactctattaggcctgcaacatttccagaccttaaactgatagaacattttaattgttttaattgtttttggaaatgatgggagagttcctaagtggagtataaactgtggagagatgaaccatcttgagtaggcactgaagtgtgctttgggtcatgatagattaattaatctcatctaaacattgatgtctttttctgttgctgtctagactgtgaacaatgtctaacaccttagggaagaggtggggaggaatcccaatgtatacattgcccttaagcagtgtttgattcattcatctttggactccatgaatcgaaatctggtagaatacatgatcttagtggaggaggccaaatgcgtgactcactgagcctggcagagcagaaatactctgctgtctgcaccctctgggtctggtgtggctctgcttcttggtgcttcaactctgactggcagctgtccccaggaggcgataattcagcatgttcaatct

SEQ ID NO: 46 - DNA, 376 bp, Homo sapien
gcaaccttgtgttaggtaatagcattaccattctgtagaggagtaaactgagacgcagcaagattaagttatatgtgcaaggataaatagggagtaatggaagagccggagtttgaatctgaataatccaacttcaaagtgttaatcaccactccaggctgcctctcagccagttgaacctcataaaattcaagactataataagtggtcaaaaacctaagacgaaactctgcttacatggttatttaatatttgattgacaatgaaaaataattttaatgcataaagtcatgttgaatgtaactacaatattaaagatcataaagagtaaagtaagtaaaatagaaaaatcaaaataaaataaaaataattatgt

SEQ ID NO: 47 - DNA, 187 bp, Homo sapien
aggacctgacatccaaaacaagatggatttctacacagagttgctaaagataccataaagaaccaagaaggaataagaaggggaaggtagaggtcagagatgtacacaggatctggccagaaagaggcttctgggtggggctggaagatgcaggggcttagaaaaagcaggggcggccaggtgcggt

SEQ ID NO: 48 - DNA, 380 bp, Homo sapien
caggcatgagccaccgtgctcttggccttaattgttctgattttaataatggcatgatacccctgtaccccaagttatacagatgagagattttggctctggtatctctgtctctatcctgggtaaggtttctcagggttgtaggccagtctctttgtcaggaagagagctagtagttaaactgaaacaaaggtccgacagtctttattttgcattttaaggtacctgttgaaaatgactaaacgtaaaatgggacttttgttaattcagtagctgttactgaagcattagattgattcacctgtttaaaagtagttatgaaagacaacagagaacagctttctatttgtcgtaacttactaatagatagccaagtctgc

SEQ ID NO: 49 - DNA, 1903 bp, Homo sapien
ttttcccccaaggaagagagtagggcagggaggtgaagaggaatggaaactccaccactccaccccgctatactagatgaagcagctgtgtctcagaaacagggcactcaggctctctggcttccagggattagagaacaaggcacagatcagcccctcccccagaatcacaggaccgccaacttggcagatgcatccaagggcaccctgactcctctgccacatggattgtaggtcccagcgatgagcagcccaattaacagtgatgtcagactgtttgggtccagatcattcctgagccatgaaacagttaagaaatatcctgccccactggctgccgtgctcataaaggtagacccacgtgtacttccctgtggctccaagaagcgccagctcgctcatttgctcacacccagcaggcagagaaggcagcagcaggcaggaccgccaccctcccatgcaaatcacccccgggagtgcagctgggctcctcccgctcctcctaggcaatgctcctggggagtctgtggggaagatgccatccagggtgctgtgcgctcttcctcatcctcgccctcctgctggacgcggtcggcctggtccttttgctgctggggatcttggcccccctgagttcctgggacttcttcatctacacaggtgccctgatcctggctctcagcctactgctctggatcatctggtattccctcaacattgaggtgtctcctgaaaaactggacctgtaatttggccatgggaagaggagaagagacgcaggtgctgtatgcagacatgtctgtgaacctggggctcttgggcagcaacacgttgcagcttccacctagcaagccacgccgggaccaggtcccatctgatggaggagaatcaattcaaggagatgcccttcctttacagaacaccctttaacagcatccaggaggaacgagaggctgcaatactgaggctttcaaagtactcacgaggatgtccgagaatggctgtgatgccaggcttctggcaggttccagactccatcacaagcccagcatccctgcaccagatctgacatcgctgctgttgtgccagctgtttatgaagggcctgagtagctagcaggtttttatcaggagccctgctgggggcttagacaccaaaagagaagtctcatcctctgtagttcttcttgtgaatgtccttttagaaaaacaattagaaccaaccacaagcaccaaagtcctaatgggatctcctgcgagcacatatcaagcaggattgttgctatttctcctcactggctctttggacagactgtgtgagctcctggagggttccactgtatctaccctttgacactgaccagttggcacatggtgacttattccaatgtgttgattgcaaatgtgaacgtacagccagtgctgtgtgcgggaggactctctcctcctcagtggggccacaccgtgcactattaatggagccccactcctttgcacagcctggccatgcagtggctcatattgaggttttagccaactgaaatctcccgtgcatttttctgacaagccagctaggcctctgctatgctgtccttgtgtctttcatttgatgaccttaagggtgggactgttttatcttaagttacaggtggtcaagtccagcccaaggacagcaactctgagggtcaagcctcataggctaactggatagatgttctctgctttgccacccactggagcccgacctgccccactaatttatatttccctggtctcattttgtactttttatttataattcacccttaaagtgtatgtgtctcttataagctgcctccgatctttcatggtatgaggtggttacctaaataaagaaggagatttggcctttgtttttatgtaaa

SEQ ID NO: 50 - DNA, 1911 bp, Homo sapien
ttttcccccaaggaagagagtagggcagggaggtgaagaggaatggaaactccaccactccaccccgctatactagatgaagcagctgtgtctcagaaacagggcactcaggctctctggcttccagggattagagaacaaggcacagatcagcccctcccccagaatcacaggaccgccaacttggcagatgcatccaagggcaccctgactcctctgccacatggattgtaggtcccagcgatgagcagcccaattaacagtgatgtcagactgtttgggtccagatcattcctgagccatgaaacagttaagaaatatcctgccccactggctgccgtgctcataaaggtagacccacgtgtacttccctgtggctccaagaagcgccagctcgctcatttgctcacacccagcaggcagagaaggcagcagcaggcaggaccgccaccctcccatgcaaatcacccccgggagtgcagctgggctcctcccgctcctcctaggcaatgctcctggggagtctgtggggaagatgccatccagggcgctgtgcgctcttcctcatcctcgccctcctgctggacgcggtcggcctggtccttttgctgctggggatcttggcccccctgagttcctgggacttcttcatctacacaggtgccctgatcctggctctcagcctactgctctggatcatctggtattccctcaacattgaggtgtctcctgaaaaactggacctgtaatttggccatgggaagaggagaagagacgcaggtgctgtatgcagacatgtctgtgaacctggggctcttgggcagcaacacgttgcagcttccacctagcaagccacgccgggaccaggtcccatctgatggaggagaatcaattcaaggagatgcccttcctttacagaacaccctttaacagcatccaggaggaacgagaggctgcaatactgaggctttcaaagtactcacgaggatgtccgagaatggctgtgatgccaggcttctggcaggttccagactccatcacaagcccagcatccctgcaccagatctgacatcgctgctgttgtgccagctgtttatgaagggcctgagtagctagcaggtttttatcaggagccctgctgggggcttagacaccaaaagagaagtctcatcctctgtagttcttcttgtgaatgtccttttagaaaaacaattagaaccaaccacaagcaccaaagtcctaatgggatctcctgcgagcacatatcaagcaggattgttgctatttctcctcactggctctttggacagactgtgtgagctcctggagggttccactgtatctaccctttgacactgaccagttggcacatggtgacttattccaatgtgttgattgaaaatgtgaacgtacagccagtgctgtgtgcgggaggactctctcctcctcagtggggccacaccgtgcactattaatggagccccactcctttgcacagcctggccatgcagtggctcatattgaggttttagccaactgaaatctcccgtgcatttttctgacaagccagctaggcctctgctatgctgtccttgtgtctttcatttgatgaccttaagggtgggactgttttatcttaagttacaggtggtcaagtccagcccaaggacagcaactctgagggtcaagcctcataggctaactggatagatgttctctgctttgccacccactggagcccgacctgccccactaatttatatttcccctggtctcattttgtactttttatttataattcacccttaaagtgtatgtgtctcttataagctgcctccgatctttcatggtatgaggtggttacctaaataaagaaggagatttggcctttgtttttatgtaaaaaaaaaa

SEQ ID NO: 51 - DNA, 2672 bp, Homo sapien
ttttcccccaaggaagagagtagggcagggaggtgaagaggaatggaaactccaccactccaccccgctatactagatgaagcagctgtgtctcagaaacagggcactcaggctctctggcttccagggattagagaacaaggcacagatcagcccctcccccagaatcacaggaccgccaacttggcagatgcatccaagggcaccctgactcctctgccacatggattgtaggtcccagcgatgagcagcccaattaacagtgatgtcagactgtttgggtccagatcattcctgagccatgaaacagttaagaaatatcctgccccactggctgccgtgctcataaaggtagacccacgtgtacttccctgtggctccaagaagcgccagctcgctcatttgctcacacccagcaggcagagaaggcagcagcaggcaggaccgccaccctcccatgcaaatcacccccgggagtgcagctgggctcctcccgctcctcctaggcaatgctcctggggagtctgtggggaagatgccatccagggtgctgtgcgctcttcctcatcctcgccctcctgctggacgcggtcggcctggtccttttgctgctggggatcttggcccccctgagttcctgggacttcttcatctacacaggtgccctgatcctggctctcagcctactgctctggatcatctggtattccctcaacattgaggtgtctcctgaaaaactggacctgtaatttggccatgggaagaggagaagagacgcaggtgctgtatgcagacatgtctgtgaacctggggctcttgggcagcaacacgttgcagcttccacctagcaagccacgccgggaccaggtgagtgcacacaagacctacctggcagggtggccagagaggcttggacaagcaggggcaagaccaggcctcctgaggctgcataagcaaatagccagacactgcaccctgactggggatcctgtggccctggcctcaggtcctgctggggtggccagccaagaggacgtggggcaggtgttttctcctccgggcccttttcctcgcagaggctggaaagagagtctcaacagccccttccacccctgatataccacgaatgatcctggcttctgggcacaatgggaagttatccctttacctcggaacttggggacaaaaagaccccatctgcattctctgttgggaagaatctctgctggggagaaaagtctttagcacaggagaggacggaaagttccccaatgactcttgtgcccttgcatacatgaaggggtgtgaactgggccacggtaaaagcaaacagagcagaaccacccagaacggcccctctcgttcacttcctccctgcacctgcccagatgggatacaagaagcggggtagggactactcgcctccatgcccactcagtgcacacacctcctctctctgcagtattcccaccccaccctcactcacactcacacgcagccaacacatgtgcccagccagtctccaaggcccagaagtcaagacagtttggcttcatggatttcatccgctgagttgcatgtcacagctcagtctatcgcgtgcaaccaaagaggcagagagttgtaagattttttcacatcaagacagagtcccagagatagagtggtctggtccttacaaccctgaattagagatggacagctgtctccaggggactgaagtcagagccacggtccattgggcagccataccctcctccccaggtgggcccaacctgcacgcaggtgtatccaggcactcccgtttcttactcccttaccagaagtaagagcaaaggtcgttgctgagttgaaagaaggaaataataattgtgtcttttgtgggggattacacctgactctcagaactcagagaaaagagaagcaaaatgaagaggtctcagtagagtaaggtaagcccatacctaggaaatgatgtagaaagagatgagaagtcagtcccactctgatcttcagcacttgttagctgggtgtttttggccaggttgcacactctgagcctcaggattctcatctgtaagatgaagagaatatttctggcccttattgctgcaaggatcgaaaagagataaggcagggaaaggctgtacaattgatgtggttcttacaccagatgtcaagcatacaaaacacataatctgggatgagttaactgacccaaagtccaaatgtgaagtaccttggtgtctctcaaattggtagtgatgggggtcaactcacactttgcatcaggaaacttcrgagcaaaaagggtccctgatttgtgtgctggtatgttggaatgtgtcaggcactgtgcaagacactggggataagaaatgagacacatggaccaggcacagtgactcatgcctgtaatcccagcactttgggaggccgaggcgggcagatcacttgaggtcaggagttcaagaccagccttggcaacatggtgaaaccccatctccaccaaaaatacaaaaaattagccacgcatggtgatgcacacctgtaatcccagctattcaggaggttgaggcagaaggattgctggagcccaggaggcacaggctgcagtgagcagagattgcaccactgcattccaacctgggcggcagagtgagacctgtctc

SEQ ID NO: 52 - DNA, 1495 bp, Homo sapien
ttttcccccaaggaagagagtagggcagggaggtgaagaggaatggaaactccaccactccaccccgctatactagatgaagcagctgtgtctcagaaacagggcactcaggctctctggcttccagggattagagaacaaggcacagatcagcccctcccccagaatcacaggaccgccaacttggcagatgcatccaagggcaccctgactcctctgccacatggattgtaggtcccagcgatgagcagcccaattaacagtgatgtcagactgtttgggtccagatcattcctgagccatgaaacagttaagaaatatcctgccccactggctgccgtgctcataaaggtagacccacgtgtacttccctgtggctccaagaagcgccagctcgctcatttgctcacacccagcaggcagagaaggcagcagcaggcaggaccgccaccctcccatgcaaatcacccccgggagtgcagctgggctcctcccgctcctcctaggcaatgctcctggggagtctgtggggaagatgccatccagggtgctgtgcgctcttcctcatcctcgccctcctgctggacgcggtcggcctggtccttttgctgctggggatcttggcccccctgagttcctgggacttcttcatctacacaggtgccctgatcctggctctcagcctactgctctggatcatctggtattccctcaacattgaggtgtctcctgaaaaactggacctgtaatttggccatgggaagaggagaagagacgcaggtgctgtatgcagacatgtctgtgaacctggggctcttgggcagcaacacgttgcagcttccacctagcaagccacgccgggaccaggtgagtgcacacaagacctacctggcagggtggccagagaggcttggacaagcaggggcaagaccaggcctcctgaggctgcataagcaaatagccagacactgcaccctgactggggatcctgtggccctggcctcaggtcctgctggggtggccagccaagaggacgtggggcaggtgttttctcctccgggcccttttcctcgcagaggctggaaagagagtctcaacagccccttccacccctgatataccacgaatgatcctggcttctgggcacaatgggaagttatccctttacctcggaacttggggacaaaaagaccccatctgcattctctgttgggaagaatctctgctggggagaaaagtctttagcacaggagaggacggaaagttccccaatgactcttgtgcccttgcatacatgaaggggtgtgaactgggccacggtaaaagcaaacagagcagaaccacccagaacggcccctctcgttcacttcctccctgcacctgcccagatgggatacaagaagcggggtagggactactcgcctccatgcccactcagtgcacacacctcctctctcaacagccccttccaccctgatataccacgaatgatcct

SEQ ID NO: 53 - DNA, 692 bp, Homo sapien
  misc_feature (83)..(83): n=a, c, g or t
gatagcatgtcatagtgtcaagaatataatctttatatgaatatagtccaagtatgaatctcagcaccagcaatctaaaagtnattttaacctcttcatagagttcctggttttcaaaggcttaatgcttttcccaaattttgattttggtgctattcttacataatttccttccatttcatatagggtcctcctggtccccaaggtgtcaaaggtgaacgtggcagtcctggtggacctgtaagtattgatcctcttaactattattgaaaagcattaattgatatcaacctgtataaaagctgcattgagacactagttccataaagagaatgtaaaaattgtaatcgctcattcatacatgagttatatgtaaattccaaggggaaacacaaaccataaatgactttcaggtacaatgcagatcatgccacacattatactttttttttgttgtacagttatttgttctacttttgaaattcaaaaatatattaccatttcacagggtgctgctggcttccctggtgctcgtggtcttcctggtcctcctggtagtaatgtaagtaattgttaaagtcttttctcatcatacacttcagaaagagcattcatgtatgtataggatgagaaacttacacattgctacttatttctctagtaagtctcaaataaaattatttgaagtaagt

SEQ ID NO: 54 - DNA, 731 bp, Homo sapien
gaccgcttaattaaagatctttttttttttttttttttacttacttcaaataattttatttgagacttactagagaaataagtagcaatgtgtaagtttctcatcctatacatacatgaatgctctttctgaagtgtatgatgagaaaagactttaacaattacttacattactaccaggaggaccaggaagaccacgagcaccagggaagccagcagcaccctgtgaaatggtaatatatttttgaatttcaaaagtagaacaaataactatacaacaaacaaaaagtataatgtgtggtatgatctgcattgtacctgaaagtcatttatggtttgtgtttccccttggaatttacatataactcatgtatgaatgagcgattacaatttttacattctctttatggaactagtgtctcaaatgcagcttttatacaggttgatatcaattaatgcttttcaataatagttaagaggatcaatacttacaggtccaccaggactgccacgttcacctttgacaccttggggaccaggaggaccctatatgaaatggaaggaaattatgtaagaatagcaccaaaatcaaaatttgggaaaagcattaagcctttgaaaaccaggaactctatgaagaggttaaaataacttttagattgctggtgctgagattcatacttggactatattcatataaagattatattcttgacactatgacatgctatc

SEQ ID NO: 55 - DNA, 1779 bp, Homo sapien
gttaaatttcttaaatctaacattcacaggagaccattttaaatcaggatttctttcctaaataactttggaaaaaatacatgaattgcacaagtagtacatgtttgtaattaggtatttcttaagcctatagaatctttgcctgagactccttctagatttaaaagtcttgaccttcaggatttaagactctggaaagatatttagtaaatggtttttaaaaataaatcagttaatttttcagttaagcttctaccatatattgaaatacataaatatctatatatataaatgtgttaaatactttaaaattctcaaactatttttcttgcaaataatatcacagtaggaggcagaaggaatcaatggttctggtattttccactcctaattttattgagaagtggcaaagtcttcagaagtttattggctactctgcacatttcctgcttaaaggaaagaaaagataagatgataagatgacatttcctgcctaaaggagatgacgcacacttcactgtgactaaggaggatatttttctcttcagggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggaccctgttggacccatgtggactcctgggaaggatggacctgtgggctcccgtccttggaccacgggtcttgagtgaccggggtgagacggttgggggtcccagggccctggcgcaagcctcttgcctctgtgcctggtctgttgtgtttggccgctgtggtggtggtactcgtttccgtttgggactgttaaaccggttttc

SEQ ID NO: 56 - DNA, 2382 bp, Homo sapien
gttaaatttcttaaatctaacattcacaggagaccattttaaatcaggatttctttcctaaataactttggaaaaaatacatgaattgcacaagtagtacatgtttgtaattaggtatttcttaagcctatagaatctttgcctgagactccttctagatttaaaagtcttgaccttcaggatttaagactctggaaagatatttagtaaatggtttttaaaaataaatcagttaatttttcagttaagcttctaccatatattgaaatacataaatatctatatatataaatgtgttaaatactttaaaattctcaaactatttttcttgcaaataatatcacagtaggaggcagaaggaatcaatggttctggtattttccactcctaattttattgagaagtggcaaagtcttcagaagtttattggctactctgcacatttcctgcttaaaggaaagaaaagataagatgataagatgacatttcctgcctaaaggagatgacgcacacttcactgtgactaaggaggatatttttctcttcagggtgagagaggtgaaactggccctccaggacctgctggtttccctggtgctcctgtaagtgtgaatatttatacatacatgtcccatagcccaggatctctatcttgctgaaaaattacaaaagtatagtcaagtttggtttctagtctcattttagctgctcattccctataggattattgtacccctattttgttttactttacccctattgtcgctctttgaaagatggaaataaaaacacctgtcctgcttttatgactgggtaatgaactaaagcagtatcatggatttaaaagcactctgaatttttgtaaattcttccattataagatggtactaattaaaattttctcttaaatccggtctttctcaaaaaaatttactggtgctgattttcaaatgtttaatccttagagacacttcctccctccctaatggcaaataatgcacagtttatgctttcttggtcatgttctttgatcatgaaaatattttgattggcttcattttgtcatgtcttcagaaagccttgtttttaaattttatttcaactccttccatctgaagaattctatattctgaagagaaataataataagccaattgtatcataaagagtgtcagctgagagattgctgttgttgttgcatgtagggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggaccctgttggacccatgtggactcctgggaaggatggacctgtgggctcccgtccttggaccacgggtcttgagtgaccggggtgagacggttgggggtcccagggccctggcgcaagcctcttgcctctgtgcctggtctgttgtgtttggccgctgtggtggtggtactcgtttccgtttgggactgttaaaccggttttc

SEQ ID NO: 57 - DNA, 1623 bp, Homo sapien
tccctctctctctccctctcccccctctgtaagtcctaagtgttctaatggaaaaacatggaggtttatcagtaatttaatattttatactgagatagcatgtcatagtgtcaagaatataatctttatatgaatatagtccaagtatgaatctcagcaccagcaatctaaaagttattttaacctcttcatagagttcctggttttcaaaggcttaatgcttttcccaaattttgattttggtgctattcttacataatttccttccatttcatatagggtcctcctggtccccaaggtgtcaaaggtgaacgtggcagtcctggtggacctgtaagtattgatcctcttaactattattgaaaagcattaattgatatcaacctgtataaaagctgcatttgagacactagttccataaagagaatgtaaaaattgtaatcgctcattcatacatgagttatatgtaaattccaaggggaaacacaaaccataaatgactttcaggtacaatgcagatcatgccacacattatactttttgtttgttgtacagttatttgttctacttttgaaattcaaaaatatattaccatttcacagggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggaccctgttggacccatgtggactcctgggaaggatggacctgtgggctcccgtccttggaccacgggtcttgagtgaccggggtgagacggttgggggtcccagggccctggcgcaagcctcttgcctctgtgcctggtctgttgtgtttggccgctgtggtggtggtactcgtttccgtttgggactgttaaaccggttttc

SEQ ID NO: 58 - DNA, 2110 bp, Homo sapien
caaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcaacaagaaccccaaggacaagaggcatgtctggttcggcgagagcatgaccgatggaattccatttccagtttggcgggcagggcttcgacccttccgatgtggccatccagctgacctt

SEQ ID NO: 59 - DNA, 1639 bp, Homo sapien
gggccgcctagagcaggaggtattagtcactgcgcccaggagccagtttacacctagcgaaggcggaggcattggacaagcctgggtctgagcagacagaaccccttcctgcgaccctggagtcccaatcgtgctgccattttccttctgcccaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgcgtgctgcgctatttcaaccccacaggtggcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaatagaaacaagttttcttacactgggaaaaaaaaa

SEQ ID NO: 60 - DNA, 598 bp, Homo sapien
acaggtgcccatgcctctggctgcattggtgaggatccccagggcataccctgccccttgatgaggcccaccccacgggtggttgtaccaacccttacggcaagtccaagttcttcatcgaggaaatgatccgggacctgtgccaggcagacaaggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 61 - DNA, 1696 bp, Homo sapien
cgtggaggggcggggtcggggccggagtgggccgtcagcacttaaagggcccgcggctcgggcgtaggaggcggtgcctctgcagcaagcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccgggtaggaagagaagggagaagtgagggaggggagggaccagatccaggcagagcggcccagaggcgtggtcagtccagcccgctccataaaccctgttctccgtgggccagatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 62 - DNA, 1939 bp, Homo sapien
cgtggaggggcggggtcggggccggagtgggccgtcagcacttaaagggcccgcggctcgggcgtaggaggcggtgcctctgcagcaagcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccgggtaggaagagaagggagaagtgagggaggggagggaccagatccaggcagagcggcccagaggcgtggtcagtccagcccgctccataaaccctgttctccgtgggccagatctacaacctgggcacgggcacaggctattcagtgctgcagatggtccaggctatggagaaggcctctgggaagaaggtaggcccccccaccccacccacctcacccacctcaccccacccagctctcagcaacagagcagctttggcccttcccactcacctctctggagggtacctggcactgcccagtctcctcagcctgcctagcacccggtgcctgcgggccagccgctgctctgcacttctgcttcttaaagacctggccagcagctgggccagggccggctcagctaagctccaactacctcctgtcttgcagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 63 - DNA, 2082 bp, Homo sapien
cgtggaggggcggggtcggggccggagtgggccgtcagcacttaaagggcccgcggctcgggcgtaggaggcggtgcctctgcagcaagcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccgggtaggaagagaagggagaagtgagggaggggagggaccagatccaggcagagcggcccagaggcgtggtcagtccagcccgctccataaaccctgttctccgtgggccagatctacaacctgggcacgggcacaggctattcagtgctgcagatggtccaggctatggagaaggcctctgggaagaaggtaggcccccccaccccacccacctcacccacctcaccccacccagctctcagcaacagagcagctttggcccttcccactcacctctctggagggtacctggcactgcccagtctcctcagcctgcctagcacccggtgcctgcgggccagccgctgctctgcacttctgcttcttaaagacctggccagcagctgggccagggccggctcagctaagctccaactacctcctgtcttgcagatcccgtacaaggtggtggcacggcgggaaggtgatgtggcagcctgttacgccaaccccagcctggcccaagaggagctggggtggacagcagccttagggctggacaggatgtgtgagtgctggcctgacccctgcagttaggggccagggaggggctaaatcagatctgggcatgcccacccagggcgggctgtggggtgggggaggctctgcattccaccgtgggccctgagcacacacctcgccgtgttgcaggtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 64 - DNA, 457 bp, Homo sapien
taaatgagagtgctcatcacctcagccccattctcctgtggaggagtaacagggtgggagtaatgtgtgaggcagaggtcactgatgccatctctccacggccagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaaggtgagggcccccttgacagtgccctggctccactgatcgatggactcctcagggcccaccctgagcccaggggtgggattccgaacacccccactaaggaggaagctaaggctcaggcagttgcagtggagggccccatcccctgcttgtttctaaagataataaatagacaact

SEQ ID NO: 65 - DNA, 2160 bp, Homo sapien
tccaaattcaggaaactgttgccatagcattttcccttctctattcctgcatagccctcctcccccgaatcagcaacaatttttgctccaccgttttctttcgggaaccagatgcgttttcagaagacagtactccagtgataaggtatctacaccacttaataactgtacctggtaaggagatttaataaggctgagggtggtattaagtttctcagaacagactcatctttgcggatgcagttgcagaacaggaaacagacccagggagaagtttagtccccccagatctcattggccctccgcacaagccaagccacagccactcctgccacacaatcggattgctttcagcactcgcagccgtggaccgccgtgcggtcctttcctccgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatctgatcacagaacaggccgatatcgcattgacccggggagctgaggtgaagggccgctgtggccacagccagtcggagctgcaagtgttctgggtggatcgcgcatatgcactcaaaatgctctttgtaaaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggcaaaaaaaaa

SEQ ID NO: 66 - DNA, 2275 bp, Homo sapien
tccaaattcaggaaactgttgccatagcattttcccttctctattcctgcatagccctcctcccccgaatcagcaacaatttttgctccaccgttttctttcgggaaccagatgcgttttcagaagacagtactccagtgataaggtatctacaccacttaataactgtacctggtaaggagatttaataaggctgagggtggtattaagtttctcagaacagactcatctttgcggatgcagttgcagaacaggaaacagacccagggagaagtttagtccccccagatctcattggccctccgcacaagccaagccacagccactcctgccacacaatcggattgctttcagcactcgcagccgtggaccgccgtgcggtcctttcctctgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatctgatcacagaacaggccgatatcgcattgacccggggagctgaggtgaagggccgctgtggccacagccagtcggagctgcaagtgttctgggtggatcgcgcatatgcactcaaaatgctctttgtaaaggtaactccgagcccagcgggcagaggggccgcaggctccgcgtgggtgtgggaagtggcggcccctaggtttaagaacccagacgctgcggggacgattgaagcgcacctccccggctcaacaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 67 - DNA, 2026 bp, Homo sapien
tccaaattcaggaaactgttgccatagcattttcccttctctattcctgcatagccctcctcccccgaatcagcaacaatttttgctccaccgttttctttcgggaaccagatgcgttttcagaagacagtactccagtgataaggtatctacaccacttaataactgtacctggtaaggagatttaataaggctgagggtggtattaagtttctcagaacagactcatctttgcggatgcagttgcagaacaggaaacagacccagggagaagtttagtccccccagatctcattggccctccgcacaagccaagccacagccactcctgccacacaatcggattgctttcagcactcgcagccgtggaccgccgtgcggtcctttcctctgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgctgtggccacagccagtcggagctgcaagtgttctgggtggatcgcgcatatgcactcaaaatgctctttgtaaaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 68 - DNA, 1062 bp, Homo sapien
tccaaattcaggaaactgttgccatagcattttcccttctctattcctgcatagccctcctcccccgaatcagcaacaatttttgctccaccgttttctttcgggaaccagatgcgttttcagaagacagtactccagtgataaggtatctacaccacttaataactgtacctggtaaggagatttaataaggctgagggtggtattaagtttctcagaacagactcatctttgcggatgcagttgcagaacaggaaacagacccagggagaagtttagtccccccagatctcattggccctccgcacaagccaagccacagccactcctgccacacaatcggattgctttcagcactcgcagccgtggaccgccgtgcggtcctttcctctgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatgtaaggaatctttcccccccctcagcttgctcctagggctccagggcgaagggcacccttcctcaaggctcttcgaagacctgggttgcccgccttctttcccacaccccggcaggctgctcccgaatgctgcatggggattccagcttgtaatgccttctgttcccctgcctgctttgaaagtaaacccccttctctccgcttccctatcggggctgcac

SEQ ID NO: 69 - DNA, 2275 bp, Homo sapien; identical to SEQ ID NO: 66

SEQ ID NO: 70 - DNA, 1826 bp, Homo sapien
tcgaaymgtaaccgttcgtacgagaatcgctgtcctctccttgcggccgcagtgtggtggaattcttttccgacacgtagtagtactgacgcttgggaacggcctgggccagaatctcgatctggcgagcgttcaggcccatgcggcggtacagggccgccgtgtcctcatccctggcgtaaatattcggcaggaaaatcttggtcgcggtcgattccacgatcacgtccaggatgccgctgttggcggcgtcggacaggctctgcgttgccatcagcacaaggcagttggccttacgcagcaccttgagccattccctgatcttcgcgcggaatgccgggtggccgagcatcaaccaggcttcgtccaggatgatgacggccgccagtgtggtggaattctaaccctgaaaaagatatatttgtggtgcgggaaaatgggacgacgtgtctcatggcagagtttgcagccaaatttattgtaccttatgatgtgtgggccagcaactacgtagatctgatcacagaacaggccgatatcgcattgacccggggagctgaggtgaagggccgctgtggccacagccagtcggagctgcaagtgttctgggtggatcgcgcatatgcactcaaaatgctctttgtaaaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 71 - DNA, 879 bp, Homo sapien
ctgttcatcaccaggtgcctgaatccctaccagaaactcctattggtgttacctatccaggacacggatttctcttgctcctttcctttctctgtcctttctctccctgaatctgagctgctttctggaagtggtcagcagcaccctccctttgccagaagtgcaaagtttggccaacactccccctagtggcaatttaacagactcctgaactgaccaacccaaaagccaaggacgagcactgatgccacgctgggttagctggggcacttgttaattaaagacatatcactgggccctacctcaggagtgtggcccagaaataggtattcttttttaacaagcatctcaagcatgggtttttgtcccatttgtacccttcctttgtcatttttatggaatacatagtgattgggattcagttttttatagaaacttgattccaatttttagtactgaatgtgaaaaaaaacattcaagcttcaaatcgattggcctagagcatgtatttcttatattttagagaagaggcaataggataagagagaagctcttgtaaactaaatatacatttctaaaaagaatagagaccagaggcgtttgttataatgtcctccagtgaacacttgtgaaaagactagctgctactttattctacctgcagctatgtcagtgtataaattacaaccaagcacgttataccttggcactgttgctttcttattctccatgtctatttctaaacatcccctatacgtgaaatttgttctccagtggccagcgagccagcctctttggagcagcctgctgatttaatcaacatgctgcttatcatgttttccagatggttaatgcatctcttaaataaaactggcccag

SEQ ID NO: 72 - DNA, 2734 bp, Homo sapien
ggagggggcaagggagaagctgctggtcggactcacaatgaaaacgctccttcttttgctgctggtgctcctggagctgggagaggcccaaggatcccttcacagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgccgggagcgagctgattttcggaggctacgaccactcccatttctctgggagcctgaattgggtcccagtcaccaagcaagcttactggcagattgcactggataatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcattttacctgatcgtttcagtggtcattgatgatcattgctgagatccacactataattaggggcggcagaacaggtgtttttctaattctgctatccctttggcatttgttagttggaattcttctataaaaaacataggccgggtacagtggctcacgcctgtaatcctagcactttcggaggccaaggcaggcagatcacgaggtcaagagatggagactatcctggccaacatggttaaaccccttctctactaaaagtacaaaaattagccaggcatggtggcacacccctgtagtcccagctacccaggaagctgaggcaggagaatcgcatgaacccaggagacagaggctgcagtgagccaagatcacgccactgcactccagactggcaacagagcgagactccttctcaaaataaaaacaaaaataataatctttggctgggccacgatggctcacgtctgtcccagcactctgggaacccaaggaaggaggattgcttgaccccagggtgtcaaagttgcagtgatctatgaccttgccactgtactccaatctgggtgatagagcaagaccttgtcttgaaaacaagataaaacaagataaaacctttccctcatcaaccatttgcccaggaaagaagacaattacttggggttttgtttcctttgtttaccagttttcagaatgagttggtactatattaaacaccaaagaattttaaacat

SEQ ID NO: 73 - DNA, 3012 bp, Homo sapien
atttacaaaatatataagtatttttaaggatgttgacacctaataattacatgctaaacgcaaacgattaatgtaatcttttaaaccgggcgtttgaaaaaaaattttcaaggtcatttcatgataaccaatcatgaatggatttaaatggagctttttgtgcacaaccagcaatgtttgtgctttctaagagtcactgacttgagaggaaagaaaaccagaaggttaatgcagtttggatattaaattcttagcaaaattaataattaaagcaaaattaattaagattttgtaagtcatcctgtcttcacatactcagatcttccaatagtggcttattttgcaagatgccacaatatctacacagaaaattgtggctatttcattattgctatagatttcaaatccaacacaaatatttaagggtgtttaagttatatttttcttgatagagggtatgctttgtgacaaaattagatttttgtccttgaaaggattaatattagcatcagttatgtatagctctatttttctagaaacaaggtattctgactacttttatagctgactacttttgggatggctacgttttgggatttaaaatagttcattgtttaatgggttgtaagaggaaaaagtgttaggatttgacagttactttttaaagggatgatcttttgtggtgtgtgtttttcctagtataagcctattgctggcgatgggcctatttaagaacagctgattttttccagtgaaaatatggtaattttaggaacacagtttgtaagttcacatttactataatgggccaaaaccataacctgccagtttgcaatacatcttgatcttttaatattcttatctgatattgtgtaattcaattcctaaactgatagttaccttgaattttgcgaaaaggtttgggtggttttttttaaacatgaaattgagggatctcatctgggcgaacaagaagagaaagctgtgaattgtactgtatcatgtacattcctgatttaatactttacagaacattttattcagatatcaatttgttacataaacatttcagcaatgatacaaagataactgataaaatatattacattcaatgaggttttctttacaaatgctctacttgaggtctgtgtcttaaagatggcatgacacctaagtacaagacatcaactgaatgaggattttaaaaaatggtatataagcataggacaagggctatgtttgtttgtttttcaaaagtgctttgaagataacagcctttaggtttgagttatttcacttttcataatttttaagtagcttatatataatggtggtaccataggattttcttttttcaaatgactgtcggcagaaacagtgggcactgactcaccttttgagttttagcagagaattatttatttctttacaatgcactttctaacccattgtagctatattagcattatcttttaaaaaagacatgcttttgtatttaaatattgtaggatttaagtgtctttctcaaaatagcttattcctttctgaaagaaaatgagggaaatactctgaattattaggagacttaaacccaatatttaaatatgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtggcccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatctaaaaaaaa

SEQ ID NO: 74 - DNA, 2969 bp, Homo sapien
  misc_feature (24)..(24): n=a, c, g or t
ccagtctggtccgccccggggtanggcatatagtcggacccacgccctcgcccatgcgtcagggagaaatttcaatgtcatttcatgataaccaatcatgaatggatttaaatggagctttttgagcacaaccagcaatgtttgtgctttctaagagtcactgacttgagaggaaagaaaaccagaaggttaatgcagtttggatattaaattcttagcaaaattaataattaaagcaaaattaattaagattttgtaagtcatcctgtcttcacatactcagatcttccaatagtggcttattttgcaagatgccacaatatctacacagaaaattgtggctatttcattattgctatagatttcaaatccaacacaaatatttaagggtgtttaagttatatttttcttgatagagggtatgctttgtgacaaaattagatttttgtccttgaaaggattaatattagcatcagttatgtatagctctatttttctagaaacaaggtattctgactacttttatagctgactacttttgggatggctacgttttgggatttaaaatagttcattgtttaatgggttgtaagaggaaaaagtgttaggatttgacagttactttttaaagggatgatcttttgtggtgtgtgtttttcctagtataagcctattgctggcgatgggcctatttaagaacagctgattttttccagtgaaaatatggtaattttaggaacacagtttgtaagttcacatttactataatgggccaaaaccataacctgccagtttgcaatacatcttgatcttttaatattcttatctgatattgtgtaattcaattcctaaactgatagttaccttgaattttgcgaaaaggtttgggtggttttttttaaacatgaaattgagggatctcatctgggcgaacaagaagagaaagctgtgaattgtactgtatcatgtacattcctgatttaatactttacagaacattttattcagatatcaatttgttacataaacatttcagcaatgatacaaagataactgataaaatatattacattcaatgaggttttctttacaaatgctctacttgaggtctgtgtcttaaagatggcatgacacctaagtacaagacatcaactgaatgaggattttaaaaaatggtatataagcataggacaagggctatgtttgtttgtttttcaaaagtgctttgaagataacagcctttaggtttgagttatttcacttttcataatttttaagtagcttatatataatggtggtaccataggattttcttttttcaaatgactgtcggcagaaacagtgggcactgactcaccttttgagttttagcagagaattatttatttctttacaatgcactttctaacccattgtagctatattagcattatcttttaaaaaagacatgcttttgtatttaaatattgtaggatttaagtgtctttctcaaaatagcttattcctttctgaaagaaaatgagggaaatactctgaattattaggagacttaaacccaatatttaaatatgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatcta

SEQ ID NO: 75 - DNA, 1608 bp, Homo sapien
gtggccgccgcctctctagctcctcagccatccgctcctcagtccagccgccgcagaggagaccagcaagcagagccctcagatgctcggagctttctcggcgcgaagctgcccgtcgccctctcctgccgccctcgcccgccgccctcctgctcctgctccggctgcggctcttggtaccccggctccgggagcccagctccccgccaccgccgccgcctgggtgtgggggctgctgaggctgagccgggcctcggcgccggctctgaggacggacgcctgaggagctgcgcggcgcggcgccgccggctggcggagaacgcccacaggcgcggggctcggcggcttgacccgggcttgtccccgtgcggccgcgggggcccctcagcggtttcccgaacggcccgactcgggcgctcctccgtgtcgcggtcgccgaccctccgcgtcccgccaacgccgccgctgcaccagtctccgggccgggctcggcgggccccgcagccgcagccatggggtgttggggtcggaaccggggccggctgctgtgcatgctggcgctgaccttcatgttcatggtgctggaggtggtggtgagccgggtgacctcgtcgctggcgatgctctccgactccttccacatgctgtcggacgtgctggcgctggtggtggcgctggtggccgagcgcttcgcccggcggacccacgccacccagaagaacacgttcggctggatccgagccgaggtaatgggggctctggtgaacgccatcttcctgactggcctctgtttcgccatcctgctggaggccatcgagcgcttcatcgagccgcacgagatgcagcagccgctggtggtccttggggtcggcgtggccgggctgctggtcaacgtgctggggctctgcctcttccaccatcacagcggcttcagccaggactccggccacggccactcgcacgggggtcacggccacggccacggcctccccaaggggcctcgcgttaagagcacccgccccgggagcagcgacatcaacgtggccccgggcgagcagggtcccgaccaggaggagaccaacaccctggtggccaataccagcaactccaacgggctgaaattggaccccgcaggtgagccgggaaagtcgctgccgcaggtggttgggtttggggtgcccagagcctcgcctggccttcggcggggtggcccgcacgccccctgctgcccgagcgggcctgcgccgcgccgcccctgcctgctccctccccgtcctgcacacgccccgctgctgctccaggaaatcagaaccccctcagtcgggtgcaaggagccggcgacgcgtctggcatatttgtaggtgggggctgtgggtcagaccctaagaaaaagggtcaggaggtgatcatcatcccgctgcagtccacacccgcacttggctgtctttacaggctgcagcaactttgctggagacttgtctggttatggttataacagcgtcagaaatgcttcccaattcaattccttggccctcttgggaaacggagagaatccccaattcgtccccagtagttgggtgctggaaaccttgctctgccaaagtagtt

SEQ ID NO: 76 - DNA, 535 bp, Homo sapien
agcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacgaagcgaaggatgttctggacagtgaagatgtttggatggttgagttctatgctccttggtgtggacactgcaaaaacctagagccagagtgggctgccgcagcttcagaagtaaaagagcagacgaaaggaagagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgattggttttctgataacgcccc

SEQ ID NO: 77 - DNA, 527 bp, Homo sapien
ccgaacttcccccatggccaccacctcccccttccctctccccagacccgctggggtgggccgctgggaggaagcccatctctgacgtggaccccgcatacaggaggtcgtgggcctgtcagatagggtcacccgaatcaagggtgatgataaaagctgtccctccaaattaggccagagcccccggagccccgctgattacagcctgtgcaccgaggacaaagggtccctctagggtcattaatatggattgaggcccattgttttctcaaattaggccacagggagcgcttcttggggaagcacatagcgggtgagggttcctgcagaatgttctggagaaatacaaggatccctctgagtacctgctgggactgagtgagcattcttaacttacacagagggtcttgctgtctgcaaagcgttatagattctcaatgcctttcaacctccagcaccttgggaattccactccaatacttaggtgtgggacagtgaggctccgaaaggtccaaaggctgtctcgc

SEQ ID NO: 78 - DNA, 658 bp, Homo sapien
ccgaacttcccccatggccaccacctcccccttccctctccccagcccgctggggtgggccgctgggaggaagcccatctctgacgtggaccccgcatacagggggtcgtgggcctgtcagattgggtcacccgaatcaagggtgatgataaaacctgtccctccaaattaggccagagccccacggagccccgctgattacagcctgtgcaccgaggacaaagggtccctctagggtcattaatatggattgaggcccattgttttctcaaattaggccacagggagcgcttcttggggaagcacatagcgggtgagggttcctgcagaatgttctggagaaataaaaggatccctctgagtacctgctgggactgagtgagcattcttaacttacacagagggtcttgctgtctgcaaagcgttttagattctcaatgcctttcaacctccagcaccttgggaattccactccaattcttagtgtgggaaagtgaggctccgaaaggtccaaaggctgtctcgctggttcgcaagcctgaatgcaggtgcccctccttcagctcgtgacatgccaatcaccgtggggactcactgaccgcgtcaagaacaggatggccagatacatcgatgcacacgtcacgtgacgacagcatgg

SEQ ID NO: 79 - DNA, 1885 bp, Homo sapien
aggcggcaggaaggtggggtctctccagccagggcttcctgaaagagctgccttctgagcaggccccccaggctaggaagatgtgcacctgccgagctgggcaggagagggtggcccagtggaggacccagcatgggcagaggtttggaggtggcaggtcctgagggaagcggaaggcagccaggttgtgacagcctgtgaggacctcttggctcccggagccttctctctcctggaatagagatgacaccgtgctgccattgaactcaacccgaaaaaatgatctgttgcaaagctcacaggaaataatggagcaatgttacacgataaactgtaaagtgtggtgagcatgtgaacaagcgtccaggacccagcgaagccccaggctactgggctaggcgtcagatgagaagaggcagagggcaacctcctgtaggatctgaggccttcatgtgctcagcccatggctgtcgtcacggtgacgtgtgcatgcgatgtatctgggccatccttgttcttgaacgcgggcagtgagtcccacggtgatgtggcatgtcacgagctgaaggaggggcacctgcattcaggcttgcgaaccagcgagacagcctttggacctttcggagcctcactttcccacactaagaattggagtggaattcccaaggtgctggaggttgaaaggcattgagaatctaaaacgctttgcagacagcaagaccctctgtgtaagttaagaatgctcactcagtcccagcaggtactcagagggatccttttatttctccagaacattctgcaggtgagctggggaagcccactggccctggcctcacccccgagcccgagccttcagcctgggaatggtctggcctcttccttgctggctctccagcctggcctcgcaggaccctgggcgggaccccaggaaccctcacccgctatgtgcttccccaagaagcgctccctgtggcctaatttgagaaaacaatgggcctcaatccatattaatgaccctagagggaccctttgtcctcggtgcacaggctgtaatcagcggggctccgggggctctggcctaatttggagggacaggttttatcatcacccttgattcgggtgacccaatctgacaggcccacgaccccctgtatgcggggtccacgtcagagatgggcttcctcccagcggcccaccccagcgggctggggagagggaagggggaggtggtggccatgggggaagttcggggtgaagaaggggtcacagccagacccccacttggatgggcctgtgatcgggttctcgggaggagcaggatattgattagatcagtgaatggtgtggaggcagctctccccaggcacgtgctcccgaccacccaccagcaagcgtctgttgcctgccggtgccagggctgggtggggactctgggacaggccggctgcctaggaggggccaggcaggagccaaggggctggctccagggactgccaggagggccccagggaaggggagccgggaagcgttttggctgcctccggcgtgaagtcgtggaaacgtgtttgcaggttagggccgtggcatcctcgttgcaccatttgagcgcctatggggtgccagatacatgacaaagggccacctcatttaatgcttccctcaaccttcccaggccccgatccccatgttctgggtcaggaggcccattcgaggtcaaggggtgggcgaaggctgacgagacaaacccagggactagctcctgagtcccaaaacctgtcctcacccacccaggggtcccctgcacgctctccagggtgtgcggtgcgtggctgctgggtttgggtgcattagagcctgaggcaagggcttgagtctgaattctcgc

SEQ ID NO: 80 - DNA, 1759 bp, Homo sapien
aggcggcaggaaggtggggtctctccagccagggcttcctgaaagagctgccttctgagcaggccccccaggctaggaagatgtgcacctgccgagctgggcaggagagggtggcccagtggaggacccagcatgggcagaggtttggaggtggcaggtcctgagggaagcggaaggcagccaggttgtgacagcctgtgaggacctcttggctcccggagccttctctctcctggaatagagatgacaccgtgctgccattgaactcaacccgaaaaaatgatctgttgcaaagctcacaggaaataatggagcaatgttacacgataaactgtaaagtgtggtgagcatgtgaacaagcgtccaggacccagcgaagccccaggctactgggctaggcgtcagatgagaagaggcagagggcaacctcctgtaggatctgaggccttcatgtgctcagcccatggctgtcgtcacggtgacgtgtgcatgcgatgtatctgggccatccttgttcttgaacgcgggcagtgagtcccacggtgatgtggcatgtcacgagctgaaggaggggcacctgcattcaggcttgcgaaccagcgagacagcctttggacctttcggagcctcactttcccacactaagaattggagtggaattcccaaggtgctggaggttgaaaggcattgagaatctaaaacgctttgcagacagcaagaccctctgtgtaagttaagaatgctcactcagtcccagcaggtactcagagggatccttttatttctccagaacattctgcaggaaccctcacccgctatgtgcttccccaagaagcgctccctgtggcctaatttgagaaaacaatgggcctcaatccatattaatgaccctagagggaccctttgtcctcggtgcacaggctgtaatcagcggggctccgggggctctggcctaatttggagggacaggttttatcatcacccttgattcgggtgacccaatctgacaggcccacgaccccctgtatgcggggtccacgtcagagatgggcttcctcccagcggcccaccccagcgggctggggagagggaagggggaggtggtggccatgggggaagttcggggtgaagaaggggtcacagccagacccccacttggatgggcctgtgatcgggttctcgggaggagcaggatattgattagatcagtgaatggtgtggaggcagctctccccaggcacgtgctcccgaccacccaccagcaagcgtctgttgcctgccggtgccagggctgggtggggactctgggacaggccggctgcctaggaggggccaggcaggagccaaggggctggctccagggactgccaggagggccccagggaaggggagccgggaagcgttttggctgcctccggcgtgaagtcgtggaaacgtgtttgcaggttagggccgtggcatcctcgttgcaccatttgagcgcctatggggtgccagatacatgacaaagggccacctcatttaatgcttccctcaaccttcccaggccccgatccccatgttctgggtcaggaggcccattcgaggtcaaggggtgggcgaaggctgacgagacaaacccagggactagctcctgagtcccaaaacctgtcctcacccacccaggggtcccctgcacgctctccagggtgtgcggtgcgtggctgctgggtttgggtgcattagagcctgaggcaagggcttgagtctgaattctcgc

SEQ ID NO: 81 - DNA, 604 bp, Homo sapien
  misc_feature (581)..(581): n=a, c, g or t
aactttttcttttttcctttttctttcctctgttctcttgcaccatgaacctcaagcagtcctgcagtgacagcagattggggtctagcaagagcttaaaactctgattttagggaaccattctcagatcagtggagctgtggttacaagagggtggaatgagtctcaattgctttttttctctctccttcatctgcttgcttccaaacaaaggcactattatggaaattgtatggctgagcagagtaaataacataccagctttctgactaggtaatgagaaaggggaatcccattgacctagaaagtactgggagattataagatatttgaaaataaactctttaaattttattatgaatttttgagcttattcatgcagtctgcatgcagaaatctgaccccaaacagtatacctagactttgagaaatgaagtaggggttagaccattgccaagtcccagactggcaacagggtgggtggtgcatctgtgggacagatccaaaaagcactgcaaagactttgaaaacttaactgacattggagttctggctggggaacagtgcaaggatgtcctctntggcaatttctattggtattgaa

SEQ ID NO: 82 - DNA, 598 bp, Homo sapien
actttttcttttttcctttttctttcctctgttctcttgcaccatgaacctcaagcagtcctgcagtgacagcagattggggtctagcaagagcttaaaactctgattttagggaaccattctcagatcagtggagctgtggttacaagagggtggaatgagtctcaattgctttttttctctctccttcatctgcttgcttccaaacaaaggcactattatggaaattgtatggctgagcagagtaaataacataccagctttctgactaggtaatgagaaaggggaatcccattgacctagaaagtactgggagattataagatatttgaaaataaactctttaaattttattatgaatttttgagcttattcatgcagtctgcatgcagaaatctgaccccaaacagtatacctagactttgagaaatgaagtaggggttagaccattgccaagtcccagactggcaacagggtgggtggtgcatctgtgggacagatccaaaaagcactgcaaagactttgaaaacttaactgacattggagttctggctggggaacagtgcaaggatgtcctctctggcaatttctattggta

SEQ ID NO: 83 - DNA, 351 bp, Homo sapien
  misc_feature (274)..(274): n=a, c, g or t
cgcgcgacccggcggcgggacaggcttgctgcttcctcctcctcggcctcaccgtttttgccaatccagaagactgtgtagcatttggcaaaggagaaaatgccaagaagtatcttcgaacagatgacagagtagaacgtgtacgcagttcattgtaaagctgttacgattagtcatatttgaacggcagagccagaatggggctacaaatgaagtgaaaagtatgctttaccgtgtgcaacaattgtgaaagttaatacatacacatatgganacaattaactaaagacttaagagcccacctgaatgacctgaaaatattattccatttctgggaattggcctcctgta

SEQ ID NO: 84 - DNA, 1536 bp, Homo sapien
ctgatgtctatttaggaagaaacaaactggtgtatatttgcttgtttctacattttctaggcactgctttgttatctgtggtggcttttcccttggaagatttctatctgggcacttaccatgcagttaacaacataccaaaaacagagcagcacaggctgttttatgtagcactgctgaccatttgccttggcattggaggcgtaagagccatcgtctgtccactgggtgcttttggccttcaggagtatggatcacaaaaaacgatgtctttttttaactgattccttcaggatattatctgcaaactatgaattccaacctgaatttggatggatttcttctgccgattgcagtaatgaatgccatcagcagcctaccattactaattctggctccttttctggagtatttcagcacctgcctgtttccctctaagagagttggatcatttctgtcaacatgcatcattgctggaaatctttttgctgcattgtctgtgatgatagctggcttctttgaaatacaccgaaaacatttccctgcagtggagcagcccctttcaggaaaagttctcactgtttcctccatgccctgtttctacctgattcttcagtatgttttacttggagtggcggaaacactggtaaacccagcccgaggggacatcgtgacaaagcaaattgtctggtatcatgaatttggaacaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagtcattgtaaagctgttacgattagcatatttgaacggcagagccagaatggggctacaaatgaagtgaaaagtatgctttaccgtgtgcaacaattgtgaaagttaatacatacacatatggaacaattaactaaagacttaagagcccacctgaatgaccttgaaaatattattccatttcttggaattggcctcctgtattccttgagtggtcccgacccctctacagccatcctgcacttcagactatttgtcggagacacggatctaccacaccattgcatatttgacaacccccttgcgccagcaaataagagcttgagtttttgttggatatgggagttactctttccatggcttacaggttgctgaaagtaacatgtcctgtacaggaattatacactcagcatccagtggtctaagaatcggattcattatatgcatatctctggattaggaggggggccgagattgaagggtaccctgataagtgcacacgttccgttaatgttgagacaacattatgtgtaaaccttaaggagtgtaaccccctgaaaacgaaatccgacgaaaaaatcgtc

SEQ ID NO: 85 - DNA, 1101 bp, Homo sapien
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagtcattgtaaagctgttacgattagcatatttgaacggcagagccagaatggggctacaaatgaagtgaaaagtatgctttaccgtgtgcaacaattgtgaaagttaatacatacacatatggaacaattaactaaaaacttaagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 86 - DNA, 951 bp, Homo sapien
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagggcacaggagatcttaggcccagaaaggcagattcagaagaacctacatgtaaatgagactggagtggaaatgagaatggcaggaaatgcatggaaacagacttgtaactgtctcatggcctggtcgtccaaatcccagaggatggagtgcaatggcatgatctcagctcaccgcaacctctgcctcccggattcaagtgattctcctgcctcagcctcttgagtagctgggattacaggtgctgcagaagtcaagagctaaccaagaagacaaggaatgtaacatatttatcaaatagcacatcatctctattataagacagtggttgttaatactatcactgacagatatttcgatttttaacaccagcaaatattagtcagatcagcactttctttagatcaggtcaatgtctgctgggcagaggtcccgtgtcgaattggtccccatcaccggcaaaacctccgagacaggggccgggcattttacaaaaccccatggccaagtatcaccgctcagcgccctccaaggtggtgtgaaaacaacccccccctcaatattatacgtttacatgatgatactttacttaatataaattaattatattgg

SEQ ID NO: 87 - DNA, 1803 bp, Homo sapien
ttacagctgtgtagtattccatggtgtatacgtaccacattgtctttatccaattcatattgatggacacctaggttgcattagcccttttttgattctctgtgaaagtctgaagcccctcccaagatttctgcagattcccttatggcatatcatctccaggttaactctggatctgggttcctgcctctatgcatgtttccatattctgcaattggttatgctggatgttaatccagccctttcatcagttcccttcaaaaatgaactaaaaaaaatgtggctaaaaatagacttgagtaagtggaagtgcagaggcgtttacactgtggcagcacaaacattttaagttgtatgttatttctctgtcagacaatggccttcagcatcctctctttgcagaatatgccccgtacctgtacctccttcacgcaagcaatgcccagtgttacaccatttttgaggctctcctctagccccacagactcttcaaccttttcagcactaaaattaaaagtaccttcttgctcatgcaaaacaattctacccccaagctattcatcaagcaagaatgtttctcttctaagaagaagtctgtgcagatacttagcacaaaatttcaccttctatctcacttagttatatacttcttaattcagcagccctgctgagtaaatcagtgagtcttgagaatgggttgtgtcaagaatatggatataaaatagtttcaggacaaagaatcactgtggaaatttcaaacagcagaacaatatcaaaggaaaaattatgtgttagacgaaaaaaaataaaaaaaagtgagtgaagcttaagttttcaaaaccactgaagagacatgaaaacttttaaagccttgtctggtcctttatgcacttccccttttagagcaggcagccgcctgcatgatgctagtcatggccctgtatttataaaattgcccagaactggaaagtgatcagaagcaattagaccctcagtagtattagtaagactgaaatgaaaatccaagtaagtctcctgtgtgaaagcgtaacaaaagatattttatttggggattttagattcctccctactattctttccgaccttccacccttactccctgcccgtgggattgtacttttagaggaaaacgacgttatctaaattgatccgctagtcaggttgcaaatgaatgttagaaagaacaattgaccccagttctgtaaaggttccgagtcctggaggaggtgcagcgactgtgtgcacagcgccccctggtgatgagacactggcttttccgcatactgagagaagagcgtctccaacagagcggagtttccagttgtataatgctttttgagacagtacctgtttcatcgaaaaagtgcctaataacacacttttggagacacttttcagacagagcgtttccagcatcttccctttccacttttaagttaagactttttttttttcacctctctcgttacttcagtcattgtaaagctgttacgattagcatatttgaacggcagagccagaatggggctacaaatgaagtgaaaagtatgctttaccgtgtgcaacaattgtgaaagttaatacatacacatatggaacaattaactaaaaacttaaggtaatatgtgttgaaataccaagatatgtgacttaaagtcagttatttgagttctggaaagacagaaaccagtgatggttagaaagcacttgacatatttatttatttatttaataccatcttagcttgtctaggaagcattcaagaccatatacattcaacac

SEQ ID NO: 88 - DNA, 898 bp, Homo sapien
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 89 - DNA, 862 bp, Homo sapien
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 90 - DNA, 714 bp, Homo sapien
gggcggtgcctgcgtccggcccgcgcggccacagtccctgcattgcgcgcgacccggcggcgggacaggcttgctgcttcctcctcctcggcctcaccagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 91 - DNA, 809 bp, Homo sapien
gggcggtgcctgcgtccggcccgcgcggccacagtccctgcattgcgcgcgacccggcggcgggacaggcttgctgcttcctcctcctcggcctcaccgtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 92 - DNA, 516 bp, Homo sapien
gctcaaaaatacaaacctgatttatttctacctttacaaactgtgttatggttatgtaggaaattcaaaatggattacaagagactgcatggccaggaaaagattaaatgtgtctcaaataattaaataaaaataatgataactgatactagaaactaaactacgattaaaatatttggatggatgggtagtgatagctccacagcagtggcaaacttgaagtcagattgtaacgaatgtttgttaccgcattaaacaataacacatccttcctgggaaaactaaaatgacaggtgtagccattgatgctttaagcatatactctgacctcatgactcacaatctgctgcagcctgtggaacacatactgtggagtcagaattatgcttagggaaagaagggctagaaaatgtagtgtaggaacttcatcttatttactgcaaaatatgtttttcaatgtcttattgagataacattttaaaaataaacatgaaaatgaacatctccctgactgct

SEQ ID NO: 93 - DNA, 535 bp, Homo sapien; identical to SEQ ID NO: 76

SEQ ID NO: 94 - DNA, 1835 bp, Homo sapien
gcccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgaggagtgcccgggagggaagctgtgcgggcagcagtcctggtttactctcttgagcctgtgcatctctgcacctggagtcaagtccttcccatcagacctcagccctggtgcacccgtgggccttttaagaggttcttctctgaagacccttcatcttccttatcacaagtttaagtgctgcatggcatttgatactcttgacagccaagatacatttcagtagtaaggttgctttcctgattattaccttaaagtgaacatttaacctggaattcatttactttatcttagaaaaatagaaaatgatagctttgaaattagcacttatttctgtactgttgtgtcccaccctcctcaaaaggacacgttcaagtggcttccagtgttaaaatggtgagtgatgtgatgttgaaatgtttcacctgagttctgagcttttccatccgtataatcataggtacga

SEQ ID NO: 95 - DNA, 4213 bp, Homo sapien
  misc_feature (1239)..(1239): n=a, c, g or t
  misc_feature (1253)..(1253): n=a, c, g or t
  misc_feature (1259)..(1259): n=a, c, g or t
gaagactctatgctggaacttggatcctcatcatttatatatataagatcttttggcatttctttaaactgatacaccaagcgctgaccttccacttttgccagaatacccctttggtaatagtacctgagtgctcttcccatggtctcataattcatatcaggtttgtttttgtgcttcccccacaacctggacactgctttagaatccaccaatttaaaaatgcctttctctcgctgggtccacttgatgtatttaggacaagtagccttgtcctggagcagtgccagtaaaaactcccaaagataaattgtgtttccctttccgtctttgtttttcttcttcacagatatatttggcgtagtggctggggaatctggtcgtggtggtttagtttttcttccttttttcctcttaggctgttctggtgatgaggctcccggtgagtctgcatatttttcttgcacctgctgtgtttccatcacttcaggaatcccatctaatgtgacggacacatgggtgactggggcaacaaccatgtcatcttcaggtgaactaaatatattattatttattcgtttttcatccagcatagggccaggggaatccatattgaggagtgcctcagcagcctcaatagtttcaattgtttcatccccgtcatgacaagaagcttcaactgtaagggtgatgtcatcatcatcatcgtctatgatttcttcttcagcaacatccagtgaactctcagtaatcatgtcactgggctcttccacacaggctagaccggcataactattgagaatatcagcaccaggaacatgttccacaattacggcaggaaaaatagctggatcaccaagctgtcgttcatcctccatgacgttactagcaaattcaaatactaggtcgttctgttggacaacagcagccataataaagcattccccttagatccacatgagaaaaattccaagaagattcacgtatcaggcagcaaaatccagtgactgatttgggtaaaaaaccctcagctctgtctgtggagtaattgtatacccaagttttctttagggaaggtgcttcagttttcctggttcattgatattctagtcaaattgagacaatttttctgaaatttttcttctctcaagcttcttggcctgacaagcataagtgcctctgcctccttcgccgcacctctcgccaccgccgcctctgcgctactgaagctgctgcttnttgccgccgccgcngccgcngccgccgctgctgcccacacgctcccgagctagggaacaagccccatccgagcgcgtgggcgtcgtaggggagaggaggggcggggccgctccgctgcaacagcaaagtttgaggcgaagcctagcgactcgcagcgccggtcccgcagtttcacctcttttttttttaactccgccagaggaccccgacccacaggtcccggttgctccgctggtcaaagtgcgtgcggagtagttggcaaagttgagagcggagacgtctctgggaacagctgtttgcgttccgggcggaggcggcgcgctgagctccttggccttgagccagcgagcctagaaggaggatggaggttttgggccccaggggaggacacagagacggcgggatggcgcagggacttgaggcttgagatcccgtccttcagctcaggtcccgtcgcgcttttaccccttcccggtgacctcaacccctttataccgaccccacctctttggagccgggagtaccggccctgtagggggaggggagaggaggcgatttcgaacgcggattggatcgtctgggcacccgtagttgggaacagcggaacgctggtcccggggactgagtaaggtgtctggatcggagggaggttcgggtgggcatcgggcggctggaagagctcgactcgtcccgctgggaaagcgcgagtctgagtggaaccctggacgacttgcagagcggctggcgcagtcatggcggactactggaagtcacagccaaagaaattctgtgattactgcaagtgctggatagcagacaataggcctagtgttgaatttcatgaaagaggaaagaatcataaggaaaatgtggcaaaaaggatcagtgagattaaacagaaaagcctggataaggcaaaggaagaagaaaaggcatcaaaggagtttgctgcaatggaggcagctgccctgaaagcataccaagaggatttgaaaagacttggcttagagtcagaaattttggagccaagcataacaccagtaaccagcactatcccacctacctcgacatcaaatcaacagaaagaaaagaaagacaagaagaaaagacaaaaagatccttcaaaaggcagatgggtagaaggcataacctctgagggttaccattactattatgatcttatctcaggagcatctcagtgggagaaacctgaaggatttcaaggagacttaaaaaagacagcagtgaagaccgtttgggtagaaggtttaagtgaagatggttttacctattactataatacagaaacaggagaatccagatgggagaaacctgatgatttcattccacacactagtgatctgccttctagtaaggtcaatgaaaattcacttggcaccctagatgaatccaaatcatcagattcgcatagtgattctgatggggaacaggaagcagaagaaggaggggtctctacagagacagaaaagccaaaaataaagtttcaggaaaaaaataaaaatagtgatggaggaagtgacccagaaacacagaaagaaaaaagtattcagaaacagaattcattaggttcaaatgaagaaaaatcgaaaactcttaagaaatcaaacccatatggagaatggcaagaaattaaacaagaggttgagtctcatgaggaggtagatttggaacttccaagcactgaaaatgagtatgtatcaacttcagaagctgatggtggcggagaacccaaagtggtatttaaagaaaaaacagtcacttctcttggagttatggcagatggagtggccccagtcttcaaaaagagaagaactgaaaatggaaaatctagaaatttaaggcaacgaggtgatgatcaatagttgcaggagagctttttgtacatgcttttaggacagaatggagacttatacacccaaagtttatctgtgtttgtttgtaagtattatgatgctaaaaatttagatttattctaaatgtatttgatgtgaattaaaataaatattttttcatgtgaaatttattttggttcctaaaatggaagcctaccacattgcattgtaatacagtgtattatgttcagtgtctaaaaactgctaattaagtcataatttaagatgctatgtatctgttatttaaaacatggagaaacagggcctttattccattcatattcataagagcatatttatcctgcattgaaaatgcattacttttgcacattgatattaactgttgtccaacaaataagtatcggagtacgtgagaatattcccagcccagtgatgatttggttctgaggctgatgtgagaaagctgatgtaaaaaatgtatgcatattggcttaccttactcaatttaaagtcaaaagccaacagccaggagcagctcaggtacttcagatgtgcttaatatggagtgaaaactggaccagaggtggaaagatgtatttgccccagttcacttcaaagcagcaaacgttgtttaagcattttagtttgaaccaggcattgtgttaggaatccagggataaagatgaatgaaatgtatttctgttcttcaggagttcacattctagcatatgccttttttcccccagtcatgcactctttttagcagtcttatatgtactagaaaagattttttaaagtttatttaaagctgtgtagatgaaggcttgatctaaaatagtataaggtctccagcttcagtaaaagtttttagtgtttacttaaattagtaatttctcactttctgtctggttaaaatgtcttaaaaagtagaattttcttctttaatccgtttagtagttacctcccttttacttttcaaattcacaaaattacatttctcataaattgtatagtatttaacttataatagttaatatttgtctttttaagatgactgtacatgtaagaaaaaagcttattaaaaacttgatcaaagaata

SEQ ID NO: 96 - DNA, 6537 bp, Homo sapien
  misc_feature (3557)..(3557): n=a, c, g or t
  misc_feature (3571)..(3571): n=a, c, g or t
  misc_feature (3577)..(3577): n=a, c, g or t
tttttatatgatttatttaataataaaccaattaaagatacaaaaatgtttagaggattccaaaatttaaatttttgtttaaatacaaattcactctgtaatatgaaaacatagcattagacctctaaacataatgatttttttcatctacaaaaatttctgttatactagaaaatttgcagaagacatttttttcttgtgacattaaatgtacattatttacagttgaaaagtaatctaaaaacatttcatttcagaaagttggatatatatgttatctttgatatgcaacccccccaagtccgcccccagtaaaaaatgatccaaaatataaagcaattatgcttttataactgactactcagccagattagcccaaggctcaagttgctttcttggcccttaagaaagagtcttgactctctcaaaatagcagtattctgtttagcacttagcaacacaagtttactaatggaccgcaaagcacagtggcctaaagagttagtaaacaaattatttaggaagaatttatggcagatcttgacccataacagatgaataaattttgttgggtcacttatttctctgcaacattttagctatcttacattaggaaataacctgataatgatttaattgacataacttgaaaatataggtattagaattaaaaaaattagaactagaagagaaagtggtgatcatctagtctaatccaatacatctcttccttttatgagaggaactaaagcccaaagaggtcaagattacatagctagttagtgggagtgccattcttaggctgatgcttttatactatcctgcttctgaaacagggtcagccataccaccagcacctccaatttttcatgttattctacatattcatagttctatattatatagtgcagtcaactaaagtcaatctaagtgacaccataattttaacaaagcataaaataggttttttgcatttgaaagagtcaagacttaacttacacaagtggaatgaaaatagttcctatataaatttcctgttgccttctatttaagttctgtatttacaaaagaatcagaaaatctaatacaatgtaaaattagaaaagaaactttaaaaatgcttatgatatagcaactgaaataaaaatctcaaaagaatgtcttcatagtgtaaaatgcctgttccttcacgattgaattctgaaacatttagataacaaagagaaacagttgagttttcctccctcatctaacaaagtcaaaattaactctatttttaacaattacaaaattagaaacctccttagaatttatcttagaatcagtcagtctgcatataattgaaaatgttcaattaacaaacaattattcataagctttggtatattaactaaaaagagttgggttccagcagttcgttttgtttcatagctacctgagaagtaaatccattggaactggacactaccatcacataaggctgtggctgctgctccgttttctcagtgttctctttcaaatgatcttcagattcctttttctctacttcctgtgtaagagtttttgtttcttgagttttgataactgaagtgattacagtgccaggtgggtgagcaaccagctgtgaactgcgaggagaaaaggtcaccacaggtgcagtagcactgaaggatggagaggaagccacactgacggttccattgcaaatggtctgaacattgctagtaaggacctgctgaacctgggcagggcccaagacaattgaaggaggagagcccgccttttgtgactgcagcatgacattttctttcagtactgtcatgggctgtgatgatggaatggcttgtaaaataaacttctgagatccagtacctgctgatggatctgtgctggctataactgttgtgagtggcactgtttggagtgttactgtatgcaactgctgattcctaggagacacaaccactggaacttgggttggagcctgtatagtcctaatactctgaacggaagaatttaatgtttcatcctgcatggtactggttctagctgcttctccctctgggacagcctgtactggctgtactacatgaacagtccggaagagctgggtaggatatggagactgcgtgggctgcactgtcctcaaaacttctgatggttgtgcaacttccacaggatctttgggttttgcagctttagaattccctggttttagaactgaagtggctcctccttttacccctggacttgaagatactctcgaccggctggtttgattcctatttgaagtggctgatgaagatagcgatggatctgaagactctatgctggaacttggatcctcatcatttatatatataagatcttttggcatttctttaaactgatacaccaagcgctgaccttccacttttgccagaatacccctttggtaatagtacctgagtgctcttcccatggtctcataattcatatcaggtttgtttttgtgcttcccccacaacctggacactgctttagaatccaccaatttaaaaatgcctttctctcgctgggtccacttgatgtatttaggacaagtagccttgtcctggagcagtgccagtaaaaactcccaaagataaattgtgtttccctttccgtctttgtttttcttcttcacagatatatttggcgtagtggctggggaatctggtcgtggtggtttagtttttcttccttttttcctcttaggctgttctggtgatgaggctcccggtgagtctgcatatttttcttgcacctgctgtgtttccatcacttcaggaatcccatctaatgtgacggacacatgggtgactggggcaacaaccatgtcatcttcaggtgaactaaatatattattatttattcgtttttcatccagcatagggccaggggaatccatattgaggagtgcctcagcagcctcaatagtttcaattgtttcatccccgtcatgacaagaagcttcaactgtaagggtgatgtcatcatcatcatcgtctatgatttcttcttcagcaacatccagtgaactctcagtaatcatgtcactgggctcttccacacaggctagaccggcataactattgagaatatcagcaccaggaacatgttccacaattacggcaggaaaaatagctggatcaccaagctgtcgttcatcctccatgacgttactagcaaattcaaatactaggtcgttctgttggacaacagcagccataataaagcattccccttagatccacatgagaaaaattccaagaagattcacgtatcaggcagcaaaatccagtgactgatttgggtaaaaaaccctcagctctgtctgtggagtaattgtatacccaagttttctttagggaaggtgcttcagttttcctggttcattgatattctagtcaaattgagacaatttttctgaaatttttcttctctcaagcttcttggcctgacaagcataagtgcctctgcctccttcgccgcacctctcgccaccgccgcctctgcgctactgaagctgctgcttnttgccgccgccgcngccgcngccgccgctgctgcccacacgctcccgagctagggaacaagccccatccgagcgcgtgggcgtcgtaggggagaggaggggcggggccgctccgctgcaacagcaaagtttgaggcgaagcctagcgactcgcagcgccggtcccgcagtttcacctcttttttttttaactccgccagaggaccccgacccacaggtcccggttgctccgctggtcaaagtgcgtgcggagtagttggcaaagttgagagcggagacgtctctgggaacagctgtttgcgttccgggcggaggcggcgcgctgagctccttggccttgagccagcgagcctagaaggaggatggaggttttgggccccaggggaggacacagagacggcgggatggcgcagggacttgaggcttgagatcccgtccttcagctcaggtcccgtcgcgcttttaccccttcccggtgacctcaacccctttataccgaccccacctctttggagccgggagtaccggccctgtagggggaggggagaggaggcgatttcgaacgcggattggatcgtctgggcacccgtagttgggaacagcggaacgctggtcccggggactgagtaaggtgtctggatcggagggaggttcgggtgggcatcgggcggctggaagagctcgactcgtcccgctgggaaagcgcgagtctgagtggaaccctggacgacttgcagagcggctggcgcagtcatggcggactactggaagtcacagccaaagaaattctgtgattactgcaagtgctggatagcagacaataggcctagtgttgaatttcatgaaagaggaaagaatcataaggaaaatgtggcaaaaaggatcagtgagattaaacagaaaagcctggataaggcaaaggaagaagaaaaggcatcaaaggagtttgctgcaatggaggcagctgccctgaaagcataccaagaggatttgaaaagacttggcttagagtcagaaatttgggagccaagcataacaccagtaaccagcactatcccacctacctcgacatcaaatcaacagaaagaaaagaaagaaaagaagaaaagaaaaaaagatccttcaaagggcagatgggtagaaggcataacctctgagggttaccattactattatgatcttatctcaggagcatctcagtgggagaaacctgaaggatttcaaggagacttaaaaaagacagcagtgaagaccgtttgggtagaaggtttaagtgaagatggttttacctattactataatacagaaacaggagaatccagatgggagaaacctgatgatttcattccacacactagtgatctgccttctagtaaggtcaatgaaaattcacttggcaccctagatgaatccaaatcatcagattcgcatagtgattctgatggggaacaggaagcagaagaaggaggggtctctacagagacagaaaagccaaaaataaagtttaaggaaaaaaataaaaatagtgatggaggaagtgacccagaaacacagaaagaaaaaagtattcagaaacagaattcattaggttcaaatgaagaaaaatcgaaaactcttaagaaatcaaacccatatggagaatggcaagaaattaaacaagaggttgagtctcatgaggaggtagatttggaacttccaagcactgaaaatgagtatgtatcaacttcagaagctgatggtggcggagaacccaaagtggtatttaaagaaaaaacagtcacttctcttggagttatggcagatggagtggccccagtcttcaaaaagagaagaactgaaaatggaaaatctagaaatttaaggcaacgaggtgatgatcaatagttgcaggagagctttttgtacatgcttttaggacagaatggagacttatacacccaaagtttatctgtgtttgtttgtaagtattatgatgctaaaaatttagatttattctaaatgtatttgatgtgaattaaaataaatattttttcatgtgaaatttattttggttcctaaaatggaagcctaccacattgcattgtaatacagtgtattatgttcagtgtctaaaaactgctaattaagtcataatttaagatgctatgtatctgttatttaaaacatggagaaacagggcctttattccattcatattcataagagcatatttatcctgcattgaaaatgcattacttttgcacattgatattaactgttgtccaacaaataagtatcggagtacgtgagaatattcccagcccagtgatgatttggttctgaggctgatgtgagaaagctgatgtaaaaaatgtatgcatattggcttaccttactcaatttaaagtcaaaagccaacagccaggagcagctcaggtacttcagatgtgcttaatatggagtgaaaactggaccagaggtggaaagatgtatttgccccagttcacttcaaagcagcaaacgttgtttaagcattttagtttgaaccaggcattgtgttaggaatccagggataaagatgaatgaaatgtatttctgttcttcaggagttcacattctagcatatgccttttttcccccagtcatgcactctttttagcagtcttatatgtactagaaaagattttttaaagtttatttaaagctgtgtagatgaaggcttgatctaaaatagtataaggtctccagcttcagtaaaagtttttagtgtttacttaaattagtaatttctcactttctgtctggttaaaatgtcttaaaaagtagaattttcttctttaatccgtttagtagttacctcccttttacttttcaaattcacaaaattacatttctcataaattgtatagtatttaacttataatagttaatatttgtctttttaagatgactgtacatgtaagaaaaaagcttattaaaaacttgatcaaagaaaaaaaaaa

SEQ ID NO: 97 - DNA, 1630 bp, Homo sapien
cgaagcctagcgactcgcagcgccggtcccgcagtttcacctctttttttttttaactccgccagaggaccccgacccacaggtcccggttgctccgctggtcaaagtgcgtgcggagtagttggcaaagttgagagcggagacgtctctgggaacagctgtttgcgttccgggcggaggcggcgcgctgagctccttggccttgagccagcgagcctagaaggaggatggaggttttgggccccaggggaggacacagagacggcgggatggcgcagggacttgaggcttgagatcccgtccttcagctcaggtcccgtcgcgcttttaccccttcccggtgacctcaacccctttataccgaccccacctctttggagccgggagtaccgcccctgtagggggaggggagaggaggcgatttcgaacgcggattggatcgtctgggcacccgtagttgggaacagcggaacgctggtcccggggactgagtaaggtgtctggatcggagggaggttcgggtgggcatcgggcggctggaagagctcgactcgtcccgctgggaaagcgcgagtctgagtggaaccctggacgacttgcagagcggctggcgcagtcatggcggactactggaagtcacagccaaagaaattctgtgattactgcaagtgctggatagcagacaataggcctgtatgataattccgctgttagagattctaataataattgtgttgaatgaagtgctcctttttgatgtaaactcagtttacaaagcacttttatgtacattgctcttgcattttcaaaacatcagaagatttctgtcttctcagtcccctatgaaagctgtgagccttcttccttttcatcaacctgactttgattatatattaaattatttctctgtggccttttgggaaatgggcaatgagttggtcatatcattcatgttatgaagcacctatattataatggtggtgttcataatactgtcatacccaaagaattgtggaaagcccttaaaaaataaaagcaacatgtttagtttttcttgtatattttgtggtctagaaataatcaagtgtatttaatgcagagctgtgtatctttagatgcttaaatttgaaagaacaccattatttcctttctcatgaaacaaagtaacaactctgttaggtatgttgttagtctgtctcatagttgagatccagttttgaagatgtaaagcaaaaagcacaccgctgatttttctcccctcttgcatgtcaaaatactatgtacataccacataaacactagggtatctgttaaatatattttatgttgataccgtttttacttggcaaagttggatgcacaaagaatagtagtctcatattttaacaatgctgtggatttcttctgtagacatttatttcctgttacctgcaaggtgtttaggatttggatttttttttgatgttttggtctttttggatagttgctaaagttcttcactattttacctaggctatccttataaataaataccatgaatttttaaaaccacacaggtcacttaaagtctctctttcttggaggtacctaggctgtaaaatgaattttgtgagttatctagagtaagtaa

SEQ ID NO: 98 - DNA, 2177 bp, Homo sapien
ccgaagtgcttgaattacaggcgtgagccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgatttttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgtatga

SEQ ID NO: 99 - DNA, 1281 bp, Homo sapien
ggcggttggggtgagagcgcctacgccacccctcccctcctccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagagcctatcagcagtctgatggggcagaagacaacagagatggaaggtgttccaaacttggcaaaggccatcaatctcaggagttagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagtagatacatttctagtttcctgggctg

SEQ ID NO: 100 - DNA, 3665 bp, Homo sapien
  misc_feature (1543)..(1565): n=a, c, g or t
  misc_feature (2711)..(2744): n=a, c, g or t
aaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtaggtatttaaaaagaaaaggtaaactgtgtgtggttaatagacatcctaatactaagcaggctttctaatgggaggctttaagtatggtgatgaacaaccacgttctgactggcgtagttatcgtaggaatctggagcatgctgtgttagaattgaccttgtttaaaactgtcccatcaaaaatggaaatccacagttcccccttcaaatgcagcactgcaccaccctgcaacacctcaggccagggaaagattactgagcattcctgcgaaccagatttctgttgtctctggatagacaagaaacaaaattcatttagtagtggagtggggaataggagtttggatagccttctaattaaaggaagctcgcctttcttggttttgggggttagaggctcttttgggaagatgcatccgagtattgtggcattctgattatgctgccttcacaaaacactctaagtgacctaagtggttatgaagcaaatgcatttatggtgaaaacagtctttgctcattgctttctcttgtttcatttagtgacaaatgatcaagatgacttgattttttttccttcttaacaatgtcttttttatttaaaccaaaggtgaagccagtgtactttctcagtgagttctctgcataaagactaatcagtgggaccaggtaaaaaggtcatataatacattgtggagattgcttacttaatacttctgaaaaatggagtaagggagaaactgtaatgttgcaatatgaacctcccattgggccttccatagggaaagctgtgactactctgaaatggaacctagcattatatccttgtagggtagattataaatcatttccagttcatttctcttagaggtgattacctctagccatcagccttactccatcccatgtttggtatgcaatttgagccacaaggctcgtatcgccaacagctatatacattttgttccatttttctgtcttacagagccatgataaaactgtggttagtgagttaaaattcctggagtaactactgtttttctcctttgaaacttaggtttctaaagttgcacctaaggaatctgtcacattttctgttgaatcatggtttttgtttttgtttttaacagatattccttctgatacggacttgaaaattagtgtatggtgacctgtgtttaaaaaaaaaagtacaatacaactacatatagctatatagcttaatgagacttnnnnnnnnnnnnnnnnnnnnnnnggtttgttgttgttgtagtagtctggtgctggccacatttaagtcttaaaaatttttaaattttgttgttgatgtttgtagacagccctgttgttgaaatcatggctttattcattttatttattttttaaacttgcctgaatttgttctaaaggaatatttaagagacataattttcttctctttaccataacattacacaaaactttttcctaaaacacggttgtgaggtactgatgaggtgtaagtggagctgttaaaaacagcagtgctgtattgcagttatgtatattcgtgtacagtatgtttagatcccaggtaaacatattcttttctgagaggataaatacctgcattcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcannnnnnnnnnnnnnnnnnnnnnnnnnnnnnnnnnttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaaagaaaaattgtacactttctgattttaacttcactaatgtaattactctctcaagaagcttttaaaatttaaattaccatcacacaaccttttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaaacattctgtgaatgaaatattgtatgttcagattttataaaagactttttaaaagcccaatttacagccgtatattttcttatggatgtaatttatgaaaaagatgtctgtacta

SEQ ID NO: 101 - DNA, 1168 bp, Homo sapien
gttatgttcatcctgtaaccttattttaaatgctcttcttacctggggttttaagagtgtggaggtggaagtagggggcttccaagatcaagtgtcccactcttccagttaaaagaagtatcttgcagtacaaaactatttgtttcctatagattcaagtctaatttacttctgcattccagtctttccagagtttttggtattctctttcgcatgaatttcccggatgtataaaggaaccagcattaccttacagcagggcagaaggagcggagctctgggttcacttggcactttctcaccctctgctgggtggcctctgcgcctctggttgttgtgtactctgaattttgacctctgtccttgccagggtgacagggggcaattaggacaacaagccagcttgaaagtcacacctgagcctctgttcagttttactgtggcaatgcaggcaagaggctgagggacaaggtgccagccccagtttgtcaggtgacagtcagatgatgcccagatgaggagaatcctctcacttcaaggaggagctccagaaggaagattctgccagttatgaacctgggagggaagaggggaaggagtgcaaaaggtgtcacggaacaagtgcctcagctcagacgctcaggcacgggtgcagagccctaggagtgcccgactgtgcctgagtccagggagcccatgctgcttgaatgggctccacccggcctctgcccatttgtgcatccatgctgctgcccacacctgtctttgcttcttgtttttagatccttgcacttggtcacctcttccacacccagcctctgctaatccctaatcccctcttctgtggggtgtgaagtcccctgagctgctgtatgtcctctttgcatttgctcttacacaaggaagcctcagaagaaacacagccttctctctgtatcttcaatggaaagtaattttgtcataaaaataactgactctggaatctttgctattacgaaaatatttgtcatgtgtggtgaaaaggtacagtaggtatcagtgtagtacaattactggcttccgtgagtctaatgtgatttaggagtctgcaggggttagcttcagggtatattgtaatttcaagactaggttctttgtacttttactagtattagaataaacttagtat

SEQ ID NO: 102 - DNA, 1269 bp, Homo sapien
gttatgttcatcctgtaaccttattttaaatgctcttcttacctggggttttaagagtgtggaggtggaagtatggggcttccaagatcagtgtccacctcttccagttaaaagaagtatcttgcagtacaaaactatttgtttcctatagattcaagtctaatttacttctgcattcagtctttcagagtttttggtattctctttcgcatgatttccggatgtataaaggaaccagcattaccttacagcagggcagaaggagcggagctctgggttcacttggcactttctcaccctctgctgggtggcctctgcgcctctggttgttgtgtactctgaattttgacctctgtccttgccagggtgacagggggcaattaggacaacaagccagcttgaaagtcacacctgagcctctgttcagttttactgtggcaatgcaggcaagaggctgagggacaaggtgccagccccagtttgtcaggtgacagtcagatgatgcccagatgaggagaatcctctcacttcaaggaggagctccagaaggaagattctgccagttatgaacctgggagggaagaggggaaggagtgcaaaaggtgtcaggaaaagtgcctcagctcagacgctcaggcacgggtgcagagccctaggagtgcccgactgtgcctgagtccagggagcccatgctgcttgaatgggctccacccggcctctgcccatttgtgcatccatgctgctgcccacacctgtctttgcttcttgtttttagatccttgcacttggtcacctcttccacacccagcctctgctaatccctaatcccctcttctgtggggtgtgaagtcccctgagctgctgtatgtcctctttgcatttgctcttacacaaggaagcctcagaagaaacacagccttctctctgtatcttcaatggaaagtaattttgtcataaaaataactgactctggaatctttgctattacgaaaatatttgtcatgtgtggtgaaaaggtacagtaggtatcagtgtagtacaattactggcttccgtgagtctaatgtgatttaggagtctgcaggggttagcttcagggtatattgtaatttcaagactaggttctttgtacttttactagtattagaataaacttagtatgaaagtggtgtctaatagttaaaataatatttcagaaagactattactgcctatcgtgtgaaaagtagagtgtaaattttcacttttaaactttaaatctccagcatt

SEQ ID NO: 103 - DNA, 1264 bp, Homo sapien
gttatgttcatcctgtaaccttattttaaatgctcttcttacctggggttttaagagtgtggaggtggaagtagggggcttccaagatcagtgtccacctcttccagttaaaagaagtatcttgcagtacaaaactatttgtttcctatagattcaagtctaatttacttctgcattcagtctttcagagtttttggtattctctttcgcatgatttccggatgtataaaggaaccagcattaccttacagcagggcagaaggagcggagctctgggttcacttggcactttctcaccctctgctgggtggcctctggcctctggttgtttgtctctgaattttgacctctgtccttgccagggtgacagggggcaattaggacaacaagccagcttgaaagtcacacctgagcctctgttcagttttactgtggcaatgcaggcaagaggctgagggacaaggtgccagccccagtgtcaggtgacagtcagatgatgcccagatgaggagaatcctctcacttcaaggaggagctccagaaggaagattctgccagttatgaacctgggagggaagaggggaaggagtgcaaaaggtgtcaggaaaagtgcctcagctcagacgctcaggcacgggtgcagagccctaggagtgcccgactgtgcctgagtccagggagcccatgctgcttgaatgggctccacccggcctctgcccatttgtgcatccatgctgctgcccacacctgtctttgcttcttgtttttagatccttgcacttggtcacctcttccacacccagcctctgctaatccctaatcccctcttctgtggggtgtgaagtcccctgagctgctgtatgtcctctttgcatttgctcttacacaaggaagcctcagaagaaacacagccttctctctgtatcttcaatggaaagtaattttgtcataaaaataactgactctggaatctttgctattacgaaaatatttgtcatgtgtggtgaaaaggtacagtaggtatcagtgtagtacaattactggcttccgtgagtctaatgtgatttaggagtctgcaggggttagcttcagggtatattgtaatttcaagactaggttctttgtacttttactagtattagaataaacttagtatgaaagtggtgtctaatagttaaaataatatttcagaaagactattactgcctatcgtgtgaaaagtagagtgtaaattttcacttttaaactttaaatctccagcatt

SEQ ID NO: 104 - DNA, 534 bp, Homo sapien
gtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctcccctccagagcctccctccggacaatgagtcccccctctt

SEQ ID NO: 105 - DNA, 1081 bp, Homo sapien
ctattggtcaggacgtttcctatgctaataaaggggtggcccgtagaagattccagcaccctcccctaactccaggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagcagcacaatcagcagctggggcgccgcagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacct

SEQ ID NO: 106 - DNA, 1075 bp, Homo sapien
ctattggtcaggacgtttcctatgctaataaaggggtggcccgtagaagattccagcaccctcccctaactccaggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgaggtcactacattaaaccataagcttcaggacgcttaagacctggttttctcttctcagtcgctccacctctgcagacgcgtctgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacct

SEQ ID NO: 107 - DNA, 672 bp, Homo sapien
ctccgaagtctagagagagaggctgcaggggaagggactgggcgcagaggtgaggggccttggggaaggagggagaatccagtgagaaggatgccctggatcgggggcgggctgatagctgtatggggcggggctatcaatgggggcgggtctatcgatggaggggaggggcttatggatgggtggggcgggtctagcgatgggggcggggcttggggccgggcttggagcggggccagtgcctgctgcctccagtctgccctgagtccctcttctggtcctttaggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacct

SEQ ID NO: 108 - DNA, 438 bp, Homo sapien
ggggaggacggagactttgatcgactccatatggagaggcaaccatgtctggaagttgactatagcctggagtcccaggcgtgcgggcgaggtggaggacatacatttcacagatgagagacaggcagattccccacaattctgcatgctttggagacctgtacaatgagaagccattggtatgtcccatgctcttgctgtagtggggaaccttgagcgtgctctgtttcaagtctcctcagatcatcaagtagtatcctgggggaaaaacagagcgtggtagacattgaagagggagcgaattgagtgtggggatggcattttgtgactttgcactgagaaattcggagatacatttgtcatcactccacttgtatattggttccggatgacgctccccgacaagagaataagataaataaattattgggctgcttt

SEQ ID NO: 109 - DNA, 674 bp, Homo sapien
gattaattgatctgatttttctgtaggttggggagttgatgaggcagagctatgcctccaaaaagtagtttctaatagcagagctgtagtccaggtttgcttcccgcagagtggagaagccagtgctagctgcaggcctgcttcatgtgaacgctttattaagtatggtctttcctcaaggtacagacactgtgggaggcaggactcctttgctcacctcctttgggattctttgcttttcaggttgcagagcctgaggcctgtgatcagatgtacgagagcttagcgcgactccattcaaactactgacaaaccacaaggtgagtgggccacagtcttttatatacccagctttctgacgggacaactaataagaatgagtgaaaatctgattaggtaatgttttgtaaagacttggctttgctgcgttcaaatgaaaccagtaatttcaaccaagccaacagaggtgcctggtagaggcttttaggccacctaaataaaagctatttaaaattgtgaatatagggaagaaacaaaaccaattatgaatagaagccatgtatttgatatgccagtgtgtgctcctgggaatgtctgacagccattggatttatacctattttcccatccactctgacggaactgacacctccccacattctggtgataaagat

SEQ ID NO: 110 - DNA, 1099 bp, Homo sapien
catccagtaacctgtatttacatgcaaatatattggtttatgcaaaacagcggaggcctcgggggagggttttttagtctcaagcttgtgcagtcattgaaaaagagacgcaaagctgtctctggggtactccacgtccgccttgcccctgggagctgggccggttccaggaggacgaagactgaattagctcggcttgcagagaaaggcgagcagcgcccctacacggagagtagcggtgcgcctacaaagtcgcgcatgcccactccggcctcccgctccactcctaaggcaggcggcgaggcttagtgcgcaagcgccattcgtcggcgccgactcctcccgctaaggcgggaacacgcggggcccaagatggcggccagccggtaccggcgttttcttaagctctgtgaggaatggccagtggacgagaccaaacggggccgggacttgggcgcttacctgcgacagcgggtagcacaggcctttcgggagggagagaatacccaggttgcagagcctgaggcctgtgatcagatgtacgagagcttagcgcgactccattcaaactactacaaacacaagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttccccttaaaaaaaaaaacaacacagaacacaaacactgtttgtggccgccctgcccccagaaaaaggtttataaaccattcgtgtgtgggcggccgcgcatagtgtcggttaaccgtgcgccacgctggtcccaaggaaaaccggggccagaactcagtggtgtggtccccaccaataaaaacgccgcgggacccgggctcggacaatccaagtggctggagccataccggctacacagcgcccaggactgatatcccgggaggggaca

SEQ ID NO: 111 - DNA, 289 bp, Homo sapien
  misc_feature (2)..(2): n=a, c, g or t
gntctagatcgcgagcagccgctcggatctagaactagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttcccctt

SEQ ID NO: 112 - DNA, 2770 bp, Homo sapien
ggcagcaacgaaggctgggagatagtcccgccattggtccgcgctgcagcttgttctggcagcgagtttagttcaggaaatttgctgagaatttgttttcacagcaagcctcatatttttgttgcaaattgtgtggcgtaacttaccaaatgtttcctctgacaggacaagaaaagacctgcagcaccttgtagtgagaggctttgagggcctggcaagtctgaaatgtgctgtgttctgggttatgtgtgtgtccaccctgggattggggtcatggaaagcgcctaagggaggcctcagtgtccacctggacactggaaacatggacttctggaaaagctccagagcaggggcttttttctgttaccttttttggtcagaaaagatactctttttttctccagtagttttgttaacgtgaaaatttaggctggtaaagcaaaacaatattataagaatatctaaaatttaacatgcacgtaaaattagatttcatggaacattagccctagagactttagacaaatggttccgtactggggggatggttttgccccccaggggacatgtggcaatgtctggagacatttttagttgtcacaactggtggtgcgggcagcggtgctactggcattagtgggtagaggccaggatgctttgaaacagccttcagtgatgcacaggccagcccacgacgaaaaattatctggcccaaagtgttggtagtgccaaggccaagaaaccctgctttggttcctgggtgtagggacgtgtatgttcttaaacaagagcccctcccgcctgcattgtggtggatgatggctgccttttcattgagtgcgggctgtgtgccaagcgagttacctccatgcttttctttaatccttacaacttttgaggtacgtgtggttttttttttcttactttttcacctctccccaagttgtctgcagatgtgtgtttttatcttcattttacagatgaggaacccgaagcgtagagggttaagtaatttgcttgaggggacccagagtgggagatgatgggctcggattcaggcccaaggccatccccctcccagtgcctgctcaactccacagcatgtgctgagtccacacaccaggattcaaatccctgctccacttcccagctgtgcaacctgagcaagttacttcactgcctcctgcctcagtttccacacctgaaaactggggacaggaagggctgtgtggagcaggccaaattttgcgatgaagcatctgggtctgtgggttgcacagcggacagcgcagggccatttctttgccctcatacggagcagggcaacgagcagcacatcccgctttgatgccgagggtgaggagagggcaggagaccactgacagcgtgctgggcacagagtctggcacacagtgctcagtccccgcaagcggtcacttctgttacctgtttgatctgctcttcaggagctgggtctccacctttttcaggaacacactgtgtgaaaagcaagccatgcttgtgtcgggaaagcccagtgggtccaatctatgtcatcaagttttagacttcagtccctctctctttttgtcttccccttttgcagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttccccttgaccttacggtttgggaatctcctctagctttcccagaaaggaagcccttgctgctctaaagaaagtttcagcctgagaagggatggtgattgagctatctgctgtgactgctgctcagggtagggaaatctcctggggagaggaaatgcaggtttccctctgggcctgatgagggtaatggggcctcggcacaaggtgcttcctgcattgccacgggagcccccgcccctctggcacgggtctggtgtctcctggcaagatactcaggctcccttttgttgtaggagctcctgggaggaagccaaaaatagcagtaaatactgaaaagggcatcctgttgcaaagagaaagcagtagggaggtgtgaggccgagagaggcaaaaagcctgcttggccctcatccccactgactcagagaaggatggaccttaggcctctatccctgaccttgcaaaaacccacattgcccagttggcttaagggacagggaagctatagacaggccttggccaagcggggcctcagctgcagttggcttcagcactgtgggcaggttctgtaggtggccacaagtcagaggccctgctggctgaggacacacacagggtcacctcattattccatggaaccttggctcttactgatattgagcatccttctctctggaaccgtgagggacagggctgggcccacagcggccctggtgggtacaaagtggaagtgggttcttaacctcgtctgtgtctagactcctcaggatgttctgaaatgcataaaataaaatcgacaggactgccgtagaaaccagttatgccgaaatgcagttctgggtaggcaaatctcaggggaggacccttgagacaggatgtcactcagcgtatctcctgagagcctgagaggccaggccagcagggaggggctcttgttcctgtcttctgccagtgtgtcctgttaatccccacagcccccgggggagtgcag

SEQ ID NO: 113 - DNA, 1819 bp, Homo sapien
catccagtaacctgtatttacatgcaaatatattggtttatgcaaaacagcggaggcctcgggggagggttttttagtctcaagcttgtgcagtcattgaaaaagagacgcaaagctgtctctggggtactccacgtccgccttgcccctgggagctgggccggttccaggaggacgaagactgaattagctcggcttgcagagaaaggcgagcagcgcccctacacggagagtagcggtgcgcctacaaagtcgcgcatgcccactccggcctcccgctccactcctaaggcaggcggcgaggcttagtgcgcaagcgccattcgtcggcgccgactcctcccgctaaggcgggaacacgcggggcccaagatggcggccagccggtaccggcgttttcttaagctctgtgaggaatggccagtggacgagaccaaacggggccgggacttgggcgcttacctgcgacagcgggtagcacaggcctttcgggagggagagaatacccaggttgcagagcctgaggcctgtgatcagatgtacgagagcttagcgcgactccattcaaactactacaaacacaagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttccccttgaccttacggtttgggaatctcctctagctttcccagaaaggaagcccttgctgctctaaagaaagtttcagcctgagaagggatggtgattgagctatctgctgtgactgctgctcagggtagggaaatctcctggggagaggaaatgcaggtttccctctgggcctgatgagggtaatggggcctcggcacaaggtgcttcctgcattgccacgggagcccccgcccctctggcacgggtctggtgtctcctggcaagatactcaggctcccttttgttgtaggagctcctgggaggaagccaaaaatagcagtaaatactgaaaagggcatcctgttgcaaagagaaagcagtagggaggtgtgaggccgagagaggcaaaaagcctgcttggccctcatccccactgactcagagaaggatggaccttaggcctctatccctgaccttgcaaaaacccacattgcccagttggcttaagggacagggaagctatagacaggccttggccaagcggggcctcagctgcagttggcttcagcactgtgggcaggttctgtaggtggccacaagtcagaggccctgctggctgaggacacacacagggtcacctcattattccatggaaccttggctcttactgatattgagcatccttctctctggaaccgtgagggacagggctgggcccacagcggccctggtgggtacaaagtggaagtgggttcttaacctcgtctgtgtctagactcctcaggatgttctgaaatgcataaaataaaatcgacaggactgccgtagaaaccagttatgccgaaatgcagttctgggtaggcaaatctcaggggaggacccttgagacaggatgtcactcagcgtatctcctgagagcctgagaggccaggccagcagggaggggctcttgttcctgtcttctgccagtgtgtcctgttaatccccacagcccccgggggagtgcag

SEQ ID NO: 114 - DNA, 415 bp, Homo sapien
gtcgaggcagccccttagggggcttaggcctgccctgtggagcatccctgcggggaactcccgccagcttgagcgacgcggatcctgcgagcgctcctgggtaggcaattgccccggtggaacgcctagtcagagcagtgcgtggcaggcccccgtggagtatcaacgcagtggctgaacaccgggaaggaacaggcacttggagtccggacatttgaaacttggaatgttgcatagaacgaccgcctcttcggctgcgtggcttcggagcagctttgactacaactcccagactgcatcgcccctgcccccccacttccggagctgacttcacttcgaggaaccttttccctccaggaatcaaggattttcttttgctttgtggccggattttgctactgcttgctcttcttac

SEQ ID NO: 115 - DNA, 1314 bp, Homo sapien
gggaacgggagatgttgcaggcgccgagagggcgggccagggccgcactccggagactcggcggttgctacgcgcaccatggctggaggtacctgcgggggattcctggggccgcggttctcttggtcctctgggttgaggcgtggcagggagtggggtggcggagcgaaggggcgtggctgaggggtcttcgtgcacaccctaccgggaggggcgctgccaggtgaggggatgccatggcggccgtgactcctaggccccctcttcctgaaggctgtcgcgccccttcctcagcgcccacggtctcgcttcctgaactccgttcactcctagcctccggacgggcccggctcttcgacgtgcgctctcgcgaggaggcggcagctgggaccatcccaggggcgctcaacatcccgggtatagggtggagaggggacgcccaggtggtggaatagagaccgttcaggaggttctttgccaatgggacctcatttaggatggaatggggaaggcactgattatgggggtcctgcattcccgggagccagccctcagcttccgtaggaaggactgatggggggcggatcttggcatcggaactggcccatccagtttgagaagacagcaggcggagaggagaggggcagaccagcttctcttgacctccccaaatctggacgcctgagggggcatcccgccccgcctcctcacagcttagggagtggcttgcattcaaaagttgtcggtttctgttccttgaaattggggtgggggtaggggatggttatcatatgttgtttgggggcccccaggacccagcccttccaggcccagcttccgaacctgagtgccaaattgctggctttcccttctaccctctccactcctccagtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactgggtacggggaggtgtggctgctagctgggaggtgatggggactgcctgtcattcctgtcagtctctcacgcttctttgtctccacagggctcgcaactacgctggagcctatagagaatggttggagaaagagagttaggcaggaggcagcttactgattgccacccctggccccttaatggccaccttaactaagggtgtgaacgggctgacttggtgaattgggcaactccttatagtgttgtgcacacaaaagcatc

SEQ ID NO: 116 - DNA, 1067 bp, Homo sapien
ttccggatccggtctcagctctgggagggaacgggagatgttgcaggcgccgagagggcgggccagggccgcactccggagactcgcggttgctacgcgcaccatggctggagcgcccacggtctcgcttcctgaactccgttcactcctagcctccggacgggcccggctcttcgacgtgcgctctcgcgaggaggcggcagctgggaccatcccaggggcgctcaacatcccgggtatagggtggagaggggacgcccaggtggtggaatagagaccgttcaggaggttctttgccaatgggacctcatttaggatggaatggggaaggcactgattatgggggtcctgcattcccgggagccagccctcagcttccgtaggaaggactgatggggggcggatcttggcatcggaactggcccatccagtttgagaagacagcaggcggagaggagaggggcagaccagcttctcttgacctccccaaatctggacgcctgagggggcatcccgccccgcctcctcacagcttagggagtggcttgcattcaaaagttgtcggtttctgttccttgaaattggggtgggggtaggggatggttatcatatgttgtttgggggcccccaggacccagcccttccaggcccagcttccgaacctgagtgccaaattgctggctttcccttctaccctctccactcctccagtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacatcgcaacggtascgagctcgatgtacc

SEQ ID NO: 117 - DNA, 742 bp, Homo sapien
gggaaaagctctgtgccatcctcaaattgcaatggcccaggtcccaccagggacacctagacgtgggctccccagacatcagggcctgggtcatgccacccacctccaccaagctgtcttctgctgggtggccgagggcatgagggcagacaccacgtgtagccctagggtggcagtgggcactgcagcagaggggctgttgctcagagtccacatgtgggggaagggagatgttgcaggcgccgagagggcgggccagggccgcactccggagactcgcggttgctacgcgcaccatggctggagtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaaaaaaaagagtagaaaaagagaaaaaactttggggggggcgttgggcccttggaaaaagtttttaagaccattggtgg

SEQ ID NO: 118 - DNA, 4633 bp, Homo sapien
gggaaaagctctgtgccatcctcaaattgcaatggcccaggtcccaccagggacacctagacgtgggctccccagacatcagggcctgggtcatgccacccacctccaccaagctgtcttctgctgggtggccgagggcatgagggcagacaccacgtgtagccctagggtggcagtgggcactgcagcagaggggctgttgctcagagtccacatgtgggggaagggagatgttgcaggcgccgagagggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaatctgcccccagaggctctcctttgtactgcccccatcccagggcctggcatgggtgtcatctgagtactgaccctgatactgtgctcatgtgtgtgggtgttgtcccctggggaacactgatcacccatctaacaccaagagctgggggcctgcccctccatcttcccaagccatgctgtcttctgtcctgctgacactcatgatcccatttcttctctttcaggaacaaagaaagggtgagtgaggtgctgtcctggggttctccaagtttgagagcatggatgcatgtggtttgaagctgaagtgggcctaggggaatgggttgaaggcagaagcaaccagtttggagggaaggcatttggatatccagccctttctctgtggccttggccctgggtctgtcctgttaccccacccatacctgtctgctgcgcacatctgtgcttctgtagcattctcgcttctggcctttaaagttggcaaggggaggttaataagcacctaggtggctgagtgtctctgtcttctggcttgttcacagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattgagtttgtttaaatcctgaa

SEQ ID NO: 119 - DNA, 4249 bp, Homo sapien
gggaaaagctctgtgccatcctcaaattgcaatggcccaggtcccaccagggacacctagacgtgggctccccagacatcagggcctgggtcatgccacccacctccaccaagctgtcttctgctgggtggccgagggcatgagggcagacaccacgtgtagccctagggtggcagtgggcactgcagcagaggggctgttgctcagagtccacatgtgggggaagggagatgttgcaggcgccgagagggcgggccagggccgcactccggagactcgcggttgctacgcgcaccatggctggagaggtacttctcagccctctagctccaactgagaacccagccagtcaggaagtcgctacttcgggaacaccaaccaatcagggggccgtcacctgctgaagggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcgtgagttgggaggggccatggagggtgtgagggtgagcagttgccggccgcctggggatctagagagcacccagcccagcctgcagtttggggctgttccccatctcgtgtatttgctgctgcttcttccttcggctcattttgaccctgtctgcagctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactgaaaatacaaagttagccaggcatggtggtgcatgcctgtaatcccagctgctcaggagcctggcaacaagagcaaaactccagctcaaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttagtagagacagggtttcaccatgttggtcgggctggtctcagactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattgagtttgtttaaatcctgaa

SEQ ID NO: 120 - DNA, 901 bp, Homo sapien
aaaggcgccagtgcgccgaggcggggagtggcggcggggttccacctggcggctggctctcagttctgaagagcagcggttccttacaccaatcggaacgtgcaggggtggggagctggccaatcaggcgcggagggcggggccgggcggggttccacctggcggctggctctcagtcccctcgctgtagtcgcggagctgtgtctgttcccaggagtccttcggcggctgttgtgtcagtggcctgatcgcgatggggacaaaggcgcaagtcgagaggaaactgttgtgcctcttcatattggcgatcctgttgtgtaagttcccagagtttcgggaggaatcggttggtcgggtcagaggttggaggaaggctctccccacgcccctagcccgcgggaggggaggagctcagaaaccttcctatatcgttctgcgaattatcttttccacccctggctggtccctctttcaccactctcacagctgggtgagtggctggctcccctcccccacactggtgagttgtgaccgcacccctcacggccaccaggagggagctgacccatctgcacacaccagaggtacactcctcgtcctcactggagagggccgtcgggccaaggacccttccacactcatctacccagcgcgcgctccacacgcacctgggaagggccagcctgcccctccaacggccacccagcatccacgaaccccgctgcgcagccgggagccttggctcctttaacggtcttcgaagaaaatcaaatggaggtggtctggggtggaagtctcttcccctagcttttgctgaaggagtctctggctcttctgaatctttgaattgcggcggttgctctgggaaaatgtctgggtgcacagtctaaagaggaaatgc

SEQ ID NO: 121 - DNA, 1339 bp, Homo sapien
gggaacgggagatgttgcaggcgccgagagggcgggccagggccgcactccggagactcgcggttgctacgcgcaccatggctggaggtacctgcgggggattcctggggccgcggttctcttggtcctctgggttgaggcgtggcagggagtggggtggcggagcgaaggggcgtggctgaggggtcttcgtgcacaccctaccgggaggggcgctgccaggtgaggggatgccatggcggccgtgactcctaggccccctcttcctgaaggctgtcgcgccccttcctcagcgcccacggtctcgcttcctgaactccgttcactcctagcctccggacgggcccggctcttcgacgtgcgctctcgcgaggaggcggcagctgggaccatcccaggggcgctcaacatcccgggtatagggtggagaggggacgcccaggtggtggaatagagaccgttcaggaggttctttgccaatgggacctcatttaggatggaatggggaaggcactgattatgggggtcctgcattcccgggagccagccctcagcttccgtaggaaggactgatggggggcggatcttggcatcggaactggcccatccagtttgagaagacagcaggcggagaggagaggggcagaccagcttctcttgacctccccaaatctggacgcctgagggggcatcccgccccgcctcctcacagcttagggagtggcttgcattcaaaagttgtcggtttctgttccttgaaattggggtgggggtaggggatggttatcatatgttgtttgggggcccccaggacccagcccttccaggcccagcttccgaacctgagtgccaaattgctggctttcccttctaccctctccactcctccagtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactgggtacggggaggtgtggctgctagctgggaggtgatggggactgcctgtcattcctgtcagtctctcacgcttctttgtctccacagggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaaaaa

SEQ ID NO: 122 - DNA, 464 bp, Homo sapien
ggtgactctgaggatccccgattcgatccggacgggcccggctcttcgacgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacatcgcatacggggactcctctatgagtc

SEQ ID NO: 123 - DNA, 806 bp, Homo sapien
gggaaaagctctgtgccatcctcaaattgcaatggcccaggtcccaccagggacacctagacgtgggctccccagacatcagggcctgggtcatgccacccacctccaccaagctgtcttctgctgggtggccgagggcatgagggcagacaccacgtgtagccctagggtggcagtgggcactgcagcagaggggctgttgctcagagtccacatgtgggggaagggagatgttgcaggcgccgagagggcgggccagggccgcactccggagactcgcggttgctacgcgcaccatggctggaggctgtcgcgccccttcctcagcgcccacggtctcgcttcctgaactccgttcactcctagcctccggacgggcccggctcttcgacgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacatcgcatacggggactcctctatgagtc

SEQ ID NO: 124 - DNA, 743 bp, Homo sapien
gggaaaagctctgtgccatcctcaaattgcaatggcccaggtcccaccagggacacctagacgtgggctccccagacatcagggcctgggtcatgccacccacctccaccaagctgtcttctgctgggtggccgagggcatgagggcagacaccacgtgtagccctagggtggcagtgggcactgcagcagaggggctgttgctcagagtccacatgtgggggaagggagatgttgcaggcgccgagagggcgggccagggccgcactccggagactcgcggttgctacgcgcaccatggctggagccggacgggcccggctcttcgacgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacatcgcatacggggactcctctatgagtc

SEQ ID NO: 125 - DNA, 461 bp, Homo sapien
agatgttgcaggcgccgagaggacccggacgggcccggctcttcgacgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacatcgcatacggggactcctctatgagtc

SEQ ID NO: 126 - DNA, 993 bp, Homo sapien
gggaaaagctctgtgccatcctcaaattgcaatggcccaggtcccaccagggacacctagacgtgggctccccagacatcagggcctgggtcatgccacccacctccaccaagctgtcttctgctgggtggccgagggcatgagggcagacaccacgtgtagccctagggtggcagtgggcactgcagcagaggggctgttgctcagagtccacatgtgggggaagggagatgttgcaggcgccgagagggcgggccagggccgcactccggagactcgcggttgctacgcgcaccatggctggaggtacctgcgggggattcctggggccgcggttctcttggtcctctgggttgaggcgtggcagggagtggggtggcggacgaaggggcgtggctgaggggtcttcgtgcacaccctaccgggaggggcgctgccaggtgaggggatgccatggcggccgtgactcctaggccccctcttcctgaaggctgtcgcgccccttcctcagcgcccacggtctcgcttcctgaactccgttcactcctagcctccggacgggcccggctcttcgacgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 127 - DNA, 1070 bp, Homo sapien
ttccggatccggtctcagctctgggagggaacgggagatgttgcaggcgccgagagggcgggccagggccgcactccggagactcgcggttgctacgcgcaccatggctggagcgcccacggtctcgcttcctgaactccgttcactcctagcctccggacgggcccggctcttcgacgtgcgctctcgcgaggaggcggcagctgggaccatcccaggggcgctcaacatcccgggtatagggtggagaggggacgcccaggtggtggaatagagaccgttcaggaggttctttgccaatgggacctcatttaggatggaatggggaaggcactgattatgggggtcctgcattcccgggagccagccctcagcttccgtaggaaggactgatggggggcggatcttggcatcggaactggcccatccagtttgagaagacagcaggcggagaggagaggggcagaccagcttctcttgacctccccaaatctggacgcctgagggggcatcccgccccgcctcctcacagcttagggagtggcttgcattcaaaagttgtcggtttctgttccttgaaattggggtgggggtaggggatggttatcatatgttgtttgggggcccccaggacccagcccttccaggcccagcttccgaacctgagtgccaaattgctggctttcccttctaccctctccactcctccagtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 128 - DNA, 1468 bp, Homo sapien
gggaaaagctctgtgccatcctcaaattgcaatggcccaggtcccaccagggacacctagacgtgggctccccagacatcagggcctgggtcatgccacccacctccaccaagctgtcttctgctgggtggccgagggcatgagggcagacaccacgtgtagccctagggtggcagtgggcactgcagcagaggggctgttgctcagagtccacatgtgggggaagggagatgttgcaggcgccgagagggcgggccagggccgcactccggagactcgcggttgctacgcgcaccatggctggaggtacctgcgggggattcctggggccgcggttctcttggtcctctgggttgaggcgtggcagggagtggggtggcggacgaaggggcgtggctgaggggtcttcgtgcacaccctaccgggaggggcgctgccaggtgaggggatgccatggcggccgtgactcctaggccccctcttcctgaaggctgtcgcgccccttcctcagcgcccacggtctcgcttcctgaactccgttcactcctagcctccggacgggcccggctcttcgacgtgcgctctcgcgaggaggcggcagctgggaccatcccaggggcgctcaacatcccgggtatagggtggagaggggacgcccaggtggtggaatagagaccgttcaggaggttctttgccaatgggacctcatttaggatggaatggggaaggcactgattatgggggtcctgcattcccgggagccagccctcagcttccgtaggaaggactgatggggggcggatcttggcatcggaactggcccatccagtttgagaagacagcaggcggagaggagaggggcagaccagcttctcttgacctccccaaatctggacgcctgagggggcatcccgccccgcctcctcacagcttagggagtggcttgcattcaaaagttgtcggtttctgttccttgaaattggggtgggggtaggggatggttatcatatgttgtttgggggcccccaggacccagcccttccaggcccagcttccgaacctgagtgccaaattgctggctttcccttctaccctctccactcctccagtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 129 - DNA, 841 bp, Homo sapien
tgggctcaggcctctcccctgactcactgtgtgtctaatctgtcaccagatgcaatctggcacttcgccgacaaccagctttttgtttcgggccccaatggcacagccggcatctttgctacctacccctctggacacttggatatgatcaatggcttctttgaccaggtatgggctggggacgtgtgaggggaacgcagggaggggaccgagttgccttggtagctcatgggctggttgggggacaggactcctcgactgtagcagggtttctccaatctgtggggtaacccgcatcagaacatggtggcaagtacttacaaaacatgcggctctccagcgggttcttgtcacgcagacattctagcaccattgctttcaggagaagagcatgggcgggcgctgacaagagtttaagagctagagggaagacgggggatggaaggaggggtcagagaaagggagggagctgcagctcaccctgttctccccactccccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaga

SEQ ID NO: 130 - DNA, 1000 bp, Homo sapien
tgggctcaggcctctcccctgactcactgtgtgtctaatctgtcaccagatgcaatctggcacttcgccgacaaccagctttttgtttcgggccccaatggcacagccggcatctttgctacctacccctctggacacttggatatgatcaatggcttctttgaccaggtatgggctggggacgtgtgaggggaacgcagggaggggaccgagttgccttgtgtagctcatgggctggttgggggacaggactcctcgactgtagcagggtttctccaatctgtggggtaacccgcatcagaacatggtggcaagtacttacaaaacatgcggctctccagcgggttcttgtcacgcagacattctagcaccattgctttcaggagaagagcatgggcgggcgctgacaagagtttaagagctagagggaagacgggggatggaaggaggggtcagagaaagggagggagctgcagctcaccctgttctccccactccccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgtgaggtacagggcagggcaacaaagatacacaggcaagccatgccgtcatccagcatgaccagagagccacgcaatggcgcaatgactaatgaagagtgtactggagaccaccacaacgagaacacgacacaaccacaatcaggtagaaaagaagtgccacacatcaacgaaaacaaaaactaccaggagagaaccacaagaacagatgaagaagagtagtacagcagccgaacagaccgaggtagaacacacgagaggagacaaaaaaaccacgcaaa

SEQ ID NO: 131 - DNA, 1990 bp, Homo sapien
agccaccagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctcgtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatggtaagcattccccaccctgtcctcctccactacccccgtccctctgttcaggacctgctggcaccaggccttttgatgacagacggctaggacctgcccaggccccgggctcatgactcactcattcacgcacagggtcaagatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 132 - DNA, 1528 bp, Homo sapien
gccaccccctctgcctgctgcaatacagcagtattgctacttacccataactcatgggagggtggggagggcacacctgagagggaagtctgggctcaggcctctcccccgactcactgtgtgtctaatctgtcaccagatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 133 - DNA, 1052 bp, Homo sapien
tttactgctgtattccaagcagaaaggttggcatacaggagacctcaaaaatacgctactttgatcttgaggagagtgaaaaatcttactcattttatgtacaaagcacagatgtgcatacattatataaaaagaaatagtttacgtatggcattaagatttcatgaagattagaaaaacaatgtttacaaaaggtccttacaaaggtagtaattcaagaaaagatcaataaacgatgtgttaaagtaagatttttggaagctcaaattcaggcaatacaaaagccagcaatatatcttgctactcgaatgcctctatttcacctcaaactcacagataaaactgaacccaatatgtccttgtccattaaaaagcaaatcaccaagaaagctaacaaaagattcccttcaatgtctcttttattgacagtggtcccaaaactcctggtcaatgaattcaaaacccaaatcttgcaggtaggacttaacctcatctgctgccaaatagctggctatgtgaccttgggcagagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacatgaaaaaaaacaaaaaagg

SEQ ID NO: 134 - DNA, 2307 bp, Homo sapien
  misc_feature (2155)..(2155): n=a, c, g or t
cctccctggggccggtggcacaggctaagcaggccaagtcaggcactcccaggaagcgggccatggaaaccaggtgtgcaaagggcctggtgcaggaagggcgggtgacgggggtgtcctggagctggagaacagcagccagccctgtttatgtgtcacttgtaaaggtgtccctgagggtctgagggcttggggcccaggaaggcactgcagggttcagacattgagggagaggccagaattgctggagggtggtgaggtgccactgggagggctgtgcatggtgacaccaagttttggaaggtacagcaagtgcatcaagagctttttggtgggtagggaatgggcactgccctttaagagcaggaatatcatcttaacagcctgttgcccccatcccgcccctgcgtggttcatggcgcaggtgggctccaccagcactgaggttgggtttagactacttcattgtcttccacccaggagaggcgtggagtgggtgcgagatcccttggtcaccaacccaagtctctgcttccctgtaccccttcacagaagccccttcagtggcttcaagtggcagtgctggctggagctgactccgccttcctgaacagcccacgtccctggaacaggccacctgcctggaacacactcagggtctggggtctcctgggcagattgctcaggcagccccttcctagcctgggcagggaccccaaggttaattcttccccttcaagggctggaattcgagcgctggctcaatgccacaggcccgccggctggctgagcccggacctgtctcagggatccagcctgacccgggcccgtggaggcccttttcccagctgtggaccgcagaacctctggaccacggcagctgcctcggccagcgccattgacatctccaagctggaggaccttccagacagcactcttcctgggaccggctcctggatgggtccccgctgccgcaggaggtggtgatgagcctgtccaagtgctactcctccctgctggactcgatgaacgctgagatccgcatccgctggctgcagattgtggtccgcaacgactactatcctgacctccacagggtgcggcgcttcctggagagccagatgtcacgcatgtacaccatcccgctgtaacgaggacctctgcaccggtgccctcaagtccttcgcgctggaggtcttctaccagacgcagggccggctgcaccccaacctgcgcagagccatccagcagatcctgttcccagggcctgggctccagcacagagcccgcctcagagcccagcactggagctgggcaaggctgaagcagacacagactcggacgcacaggccctgctgcttggggacgaggcccccagcagtgccatctcctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctcctttgtgtcttggcagagacctgtggactttggcctccccgactcccagcttctccttgcactcgcaggtcctgggggccagcccgcacacaccatgccctcctgtctcaaacactgacagctgtgcctagccccggattgccagcacctgtccaggtgccgccccggggcaaagggccccagcagccctatggtgaccgccacaactgtgcctttaatgtctgccgggggcccagtgctgtgcttgtaccctgcagcacgctctccttgcagggattctgagccaccctgccccgcacatggcctctgccaccccgcccctagggttggcagcctcagttggcccctggcagaggaacaaggacacagacattccctcagtgtggggggcagggcacaccagggagaggatggttgtccctggggagggccctctggccccaggctaactcttagccccctcagaaccagggagtcccaggacccagggagagtgtggggacaggacagcctgtactcttgtagcttctctggggtgggaggcatcaggggcaaagcaattaccccaggganaagtgggaggtggtgctggtgcgtctctgcaggcccaccatgtctgggagaggcggccagagcctgggggcctccagcctgggactgcttgtgatggggtatcacggtgatggtcccattaaacttaccactctgcaaacctgaaaaaaaaa

SEQ ID NO: 135 - DNA, 2194 bp, Homo sapien
ggagctcaccgcaggggctgggctgatccctgctgggtggaaggtggggtgcgggtgtgcagggtgggagtctgagccccgaggtctgccaccctcaccgccctcccggtgcaggtacgacattgtcttcctgccaccctccttccccatcgtggccatggagaacccctgcctcaccttcatcatctcctccatcctggagagcgatgagttcctggtcatcgatgtcatccacgaggtggcccacagttggttcggcaacgctgtcaccaacgccacgtgggaagagatgtggctgagcgagggcctggccacctatgcccagcgccgtatcaccaccgagacctacggtgctgccttcacctgcctggagactgccttccgcctggacgccctgcaccggcagatgaagcttctgggagaggacagcccggtcagcaaactgcaggtcaagctggagccaggagtgaatcccagccacctgatgaacctgttcacctacgagaagggctactgcttcgtgtactacctgtcccagctctgcggagacccacagcgctttgatgactttctccgagcctatgtggagaagtacaagttcaccagcgtggtggcccaggacctgctggactccttcctgagcttcttcccggagctgaaggagcagagcgtggactgccgggcagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcaggaggtggtgatgagcctgtccaagtgctactcctccctgctggactcgatgaacgctgagatccgcatccgctggctgcagattgtggtccgcaacgactactatcctgacctccacagggtgcggcgcttcctggagagccagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctagggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctga

SEQ ID NO: 136 - DNA, 1941 bp, Homo sapien
ggctctgagcagcagtcacagtggtgtgtgagtcctcagtcttccccgaggccctgccgctgcacgcccagggcatcagtacacatctggacatgtgagggacagtggcgcttggcccttgctgctcctcggagcctgaccactgcccctccctattccacgggacactggtggtttcggacgccagcccaggtgggtgttcaccttgcaggagtgaatcccagccacctgatgaacctgttcacctacgagaagggctactgcttcgtgtactacctgtcccagctctgcggagacccacagcgctttgatgactttctccgagcctatgtggagaagtacaagttcaccagcgtggtggcccaggacctgctggactccttcctgagcttcttcccggagctgaaggagcagagcgtggactgccgggcagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcaggaggtggtgatgagcctgtccaagtgctactcctccctgctggactcgatgaacgctgagatccgcatccgctggctgcagattgtggtccgcaacgactactatcctgacctccacagggtgcggcgcttcctggagagccagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctagggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctga

SEQ ID NO: 137 - DNA, 3110 bp, Homo sapien
gtagcgggcgtcccgcctgccgccgccgagacgccctgcgccttcgccttctccgcccccgggccggggcccgcgccgccgcccccgctgcccgccttccccgaggcgcccggctccgagcccgcctgctgtccgctggccttcagggtggacccgttcaccgactacggctcctcgctcaccgtcacgctgccgcccgagctgcaggcgcaccagcccttccaggtcatcctgcggtacacctcgaccgacgcccccgccatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggcgccatcgggggtgcaggtgctgatgagtgccacccggagtgcatacatggaggaagaaggcgtcttccacttccacatggagcaccccgtgcccgcctacctcgtggccctggtggccggagacctcaagccggcagacatcgggcccaggagccgcgtgtgggccgagccatgcctcctgcccacggccaccagcaagctgtcgggcgcagtggagcagtggctgagtgcagctgagcggctgtatgggccctacatgtggggcaggtacgacattgtcttcctgccaccctccttccccatcgtggccatggagaacccctgcctcaccttcatcatctcctccatcctggagagcgatgagttcctggtcatcgatgtcatccacgaggtggcccacagttggttcggcaacgctgtcaccaacgccacgtgggaagagatgtggctgagcgagggcctggccacctatgcccagcgccgtatcaccaccgagacctacggtgctgccttcacctgcctggagactgccttccgcctggacgccctgcaccggcagatgaagcttctgggagaggacagcccggtcagcaaactgcaggtcaagctggagccaggagtgaatcccagccacctgatgaacctgttcacctacgagaagggctactgcttcgtgtactacctgtcccagctctgcggagacccacagcgctttgatgactttctccgagtgagcagccccctgcccgggacggccctgctgccatctgcccccagcccctccccggctcacagggctgcctgctcttgcggcagttggggtggaactggcaggggcctgtgagcctggctgggacctagtctgcctttctttgtggggagtgcctgggttgccacctccccttctgccaccctgtttgctcccttggcagggcctgcgtgccaagtgctggctccgcagtgcccactagctgcccctgtgcccagcacgtaccttggcgcacgccctgcagtgccctgcaggcctctggtggggctgcctgtgccccacccttccaggcctgctgaggccccacctctgccacacaggcctatgtggagaagtacaagttcaccagcgtggtggcccaggacctgctggactccttcctgagcttcttcccggagctgaaggagcagagcgtggactgccgggcagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcaggaggtggtgatgagcctgtccaagtgctactcctccctgctggactcgatgaacgctgagatccgcatccgctggctgcagattgtggtccgcaacgactactatcctgacctccacagggtgcggcgcttcctggagagccagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctagggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctga

SEQ ID NO: 138 - DNA, 695 bp, Homo sapien
tatgattcagatgaaagagaatgtcagatcagtgaaacagaataaatgaacccagaccagaatctcgtacatgcgggcagaagacaggaagggcagaggtgtctagggcagaggtggaactagaacaaatggtagttacttggggaaaaggtgaagttagatctgtaccttatgccaaaatgaatttcaaatgagtttaaaagttaaatgaaaaatagaatacaacatatttgaaagatagtcactttaaatttgactgttaatatctgtattacataaaaagtcttcccaaagtcaataaggaaaacattaaaaacttcaaatagcaaaaagggcagacagttcacaaaaatttctcacagtaaatacgaatgactaataaatatggggagagggtgaattttggtgatttttagctttacagatagtaaaaaatgccaaaagggtgtccttttgatctatcaaattagtaaaaataaaatttttactcatccttactcatcagtgctaataacttgtgtattagcactgataaactgttggtctgtaaattggtaaaagtgggtaaaaattgattaaatttttcggattataaaaaagcttagatggcggcggtggtcacaccgttaatcccagcacttggaaggccgaagcgggtgattttcgaaatctgactcaagtgatccactgcctga

SEQ ID NO: 139 - DNA, 733 bp, Homo sapien
tgccaaaggcgtataccaaaaaaaaaagagagagagagaaaatagttgacagagagaaaatagttgagaacagttagtagacatagtagacgaaaaggctgttgcctgaggaagtcgcagtaactaagaccgtatgattcagatgaaagagaatgtcagatcagtgaaacagaataaatgaacccagaccagaatctcgtacatgcgggcagaagacaggaagggcagaggtgtctagggcagaggtggaactagaacaaatggtagttacttggggaaaaggtgaagttagatctgtaccttatgccaaaatgaatttcaaatgagtttaaaagttaaatgaaaaatagaatacaacatatttgaaagatagtcactttaaatttgactgttaatatctgtattacataaaaagtcttcccaaagtcaataaggaaaacattgaaaacttcaaatagcaaaaagggcagacagttcacaaaaatttctcacagtaaatacgaatgactaataaatatggggagagggtgaattttggtgatttttagctttacagatagtaaaaaatgccaaaagggtgtccttttgatctatcaaattagtaaaaataaaatttttactcatccttactcatcagtgctaataacttgtgtattagcactgataaactgttggtctgtaaattggtaaaagtgggtaaaaattgattaaatttttcggattataaaaaagc

SEQ ID NO: 140 - DNA, 2734 bp, Homo sapien; identical to SEQ ID NO: 72

SEQ ID NO: 141 - DNA, 1192 bp, Homo sapien
agatgctgtcgagcggcgcagtgtgatggatcggcgcccgggcagagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaattgggtcccagtcaccaagcaagcttactggcagattgcactggataacatccaggtgggaggcactgttatgttctgctccgagggctgccaggccattgtggacacagggacttccctcatcactggcccttccgacaagattaagcagctgcaaaacgccattggggcagcccccgtggatggagaatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctgcccgggcggccgatccatcacactgcgccgctcgacatgcattag

SEQ ID NO: 142 - DNA, 862 bp, Homo sapien
ttttttttttttggtagtgatttatatatatttattatagatttataataaaataaaaaatgctattggaattctatatttacacatgctccatttatatacacgcaaacaaatgtcaatatcaatggtaaaattttaggattttaaagaggcacatttcctcctacctacccacttccacatattcattactctaagatgagttttcataagcaacatttagatttgtgaaggaaaaaaatgaatatttctagtacttatcctctttcctttcatgcttttgtttgagaaaggaagcagcacataaaatctaaaacagaaactaaggctgtaagaccttctgtaatacatgttcacactcatgcatgagttgactgtaataggtcagaagatatttgagcaaagtaatgcacttacatgtatatgcactgcatataagtgatactcttcagacacacacacacagacacacacactcatgtttcttgaaaataacatgttaactatactatgtaaccccaagaatttatcaccaagaatacttccatggtgcaactgctgattataatttaccaataaatgcctctatatagccaacaacacaccatgaaaaggaaaacaaaagccagttattgtgaaacaaaggcaaattaaagatacacaaacatcttgagtgttaatatactaagaagacagttattataaaagggtatctgaacccacctacattattgaacgtctcttaaatttacttagccaatttctaagtctcaattacttagactttataggcacctaagggtctggtcttttcccaagaaaataccccagccaaaatctttcacagcaggaaacagaagac

SEQ ID NO: 143 - DNA, 848 bp, Homo sapien
  misc_feature (384)..(413): n=a, c, g or t
gtcttctgtttcctgctgtgaaagattttggctggggtattttcttgggaaaagaccagacccttaggtgcctataaagtctaagtaattgagacttagaaattggctaagtaaatttaagagacgttcaataatgtaggtgggttcagatacccttttataataactgtcttcttagtatattaacactcaagatgtttgtgtatctttaatttgcctttgtttcacaataactggcttttgttttccttttcatggtgtgttgttggctatatagaggcatttattggtaaattataatcagcagttgcaccatggaagtattcttggtgataaattcttggggttacatagtatagttaacatgttattttcaagaaacannnnnnnnnnnnnnnnnnnnnnnnnnnnnnaagagtatcacttatatgcagtgcatatacatgtaagtgcattactttgctcaaatatcttctgacctattacagtcaactcatgcatgagtgtgaacatgtattacagaaggtcttacagccttagtttctgttttagattttatgtgctgcttcctttctcaaacaaaagcatgaaaggaaagaggataagtactagaaatattcatttttttccttcacaaatctaaatgttgcttatgaaaactcatcttagagtaatgaatatgtggaagtgggtaggtaggaggaaatgtgcctctttaaaatcctaaaattttaccattgatattgacatttgtttgcgtgtatataaatggagcatgtgtaaatatagaattccaatagcattttttattttattataaatctataataaatatatataaatcacta

SEQ ID NO: 144 - DNA, 284 bp, Homo sapien
  misc_feature (162)..(162): n=a, c, g or t
  misc_feature (172)..(172): n=a, c, g or t
  misc_feature (230)..(230): n=a, c, g or t
cttttgtctttccgtggagctgtcgccatgaaggtcgagctgtgcagttttagcgggtacaagatctaccccggacacgggaggcgctacgccagggaccgacgggaaggttttcccagtttcttaatgcgaaatgcggagttcggcttttccttttccaangagggaattncctcggcaagattaaacttgggacttgtccctcttaccaggaagggaaggcaccaaanaaaggggaccagttcgggaaaggaaaattttcaaaaaaggaaaaaaggaacccc

SEQ ID NO: 145 - DNA, 2244 bp, Homo sapien
  misc_feature (962)..(962): n=a, c, g or t
  misc_feature (980)..(980): n=a, c, g or t
  misc_feature (984)..(984): n=a, c, g or t
gctctgtgaaggcacggtatgaggctagaggagccctgggtctgcctttacttacccgggtctgctctagccctagccctcgggagtcagggaaggggaattgcctaagtaacaaagggggcttttgggtggggtttcccacccaagttcaagaggaggagcagacatctgtctctgcccccttcctttggtcttcttcctccaggatctgtgtctcagctcctgcctctcactccctctctatctgccttctgtttctctttgggtctctcctgctctcctctttctggcctgcctcctctctctaatcctgcctctcttcctctcccccccttgccttgccccctctcactctaggccctcagctccagcctctggccctgacctcgagctgtgtcctgattctgtctctgccccaggactgcagggctccaggaggtctgggctgcctccagcttcccactcccaggttgcggctggactgggactggttcctttccagttgaatctggcagccaaacctctcctccccctcacctgacaggtgcagcggcctggctggggagcccgcccgccggccggccagggatggaagcgacaggaatctcattagcatctcaattaaaggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagcnactttctgactgcccgcntggnactgaagccgagctcaaagatgaagttgggaagggtaacaaccactgcgtcccctgcaaggcagggcacttccagaatacctcctcccccagcgccctgctgccagccccacaccaggtgtgagaaccaaggtctggtggaggcagctccaggcactgcccagtccgacacaacctgcaaaaatccattagagccactgcccccagagatgtcaggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgactgagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggacctaga

SEQ ID NO: 146 - DNA, 2077 bp, Homo sapien
ccggcctggctcccagcgctccctgtccccgccccgcggccagctcgctccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 147 - DNA, 2048 bp, Homo sapien
ccggcctggctcccagcgctccctgtccccgccccgcggccagctcgctccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgaggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 148 - DNA, 1778 bp, Homo sapien
ccggcctggctcccagcgctccctgtccccgccccgcggccagctcgctccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 149 - DNA, 2785 bp, Homo sapien
ccggcctggctcccagcgctccctgtccccgccccgcggccagctcgctccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcagaacctgccctgagcaagggggtggagaacttgcaagccctgctctaccaggcggccacaggcagttccgaagcaagtttccctactctctcacccctgtaaacacccccacaggtacaggtacagcagggcaaccctagctcctctacagcagcccctctgtacaatggctgaggccacagaaatgtggctctagcctgtgtctgtttacaactccaagtcccacccttccctactgtctcccaatcccacttccagaccttgaaaatcaactgcctaagctcccatcctgcacacacaagcctgcccaatcctggtctctgagcaggagggcacccacaccacccccaaacatgcccatccatgatacagtctctcctggctgccaagaggtcctcaagtccaacttagttccccttctctataacccaagggaagtttctctcattctgcctttaggagctgcattgtgtctagaaggaaaaaagctgctcccttttctctgtctgggttgcccagggatctggaaagctcttccttctcctcctcccctctgcccttcttggggctgtgatcaccctcctgtctgctgtcctggcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 150 - DNA, 1214 bp, Homo sapien
aagaagagggagggagggagagagaaaaaagggtctggggccctcatcattgtttgggtctccatctctttcctgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 151 - DNA, 1276 bp, Homo sapien
ccggcctggctcccagcgctccctgtccccgccccgcggccagctcgctccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcaggtaatggcgggggctgagaaggcagcaagaaggggaagaggtgatgagggtacaaggtggagcagacaggaagagagtatgcaggctgactccacactcattcattcattcaactgatgatttactgaacatgccacgtaccaggcactgtcctaggcactgggcgtacagcagtgagcaaaacacagtacctcatttcctggagttcacatgcccatggagcaaga

SEQ ID NO: 152 - DNA, 424 bp, Homo sapien
gaggtctgtgaggaccaatttgtgggtagttcatcttccctcgattggttaactccttagtttcagaccacagactcaagattggctcttcccagagggcagcagacagtcaccccaaggcaggtgtagggagcccagggaggccaatcagccccctgaagactctggtcccagtcagcctgtggcttgtggcctgtgacctgtgaccttctgccagaattgtcatgcctctgaggccccctcttaccacactttaccagttaaccactgaagcccccaattcccacagcttttccattaaaatgcaaatggtggtggttcaatctaatctgatattgacatattagaaggcaattagggtgtttccttaagcaactacacaccaacctgctggctttagaataaaagccccaactgaactgag

SEQ ID NO: 153 - DNA, 541 bp, Homo sapien
  misc_feature (242)..(242): n=a, c, g or t
gggggattgccaggtgagcttgactgggctgttggtggagatcagcctagtttggcccacatctgacatgagagttatggcctctagagcatgaccttcctcttgatgttgctgctcatcttcttctacatttttgctgtgactggtgtctacgtcttctcagagtacacccgttcacctcgtcaggacctggagtaccatgtgttcttctcgtaagcagagctgagtgacagctgggtgangggagaaaatttggctaagagaccaggaagcttgtccaaagtatagtaatataaaaagtgcagtctattccaagaaactgaaatagaacacaatagggagagggaaagagaaagcaaaagaatagtgaatggtattagctctgatcttgaggttagggcagctagttccatgtttattctgggttttgcaaattcaaaccacactgtcatcaggcatctttaaatagcagtacactccagtggttaagcttggtttctgtgactcagttacctcttttgaaaaatgggggcagggcgcg

SEQ ID NO: 154 - DNA, 739 bp, Homo sapien
ctaagatcttttcactattgttcctcttacacccctctccacatggctttgactgccttcaaccttttgtagctgaattacatcatccacaaagtttgccaaatagcccgtccagagctgctggatgaccagcaccctgtggtccggttgctgcgcagtttttcctctgactgtacagggggccggccagtctccttggatgccacgctggcgcatcacctgcaccagtgctcctaccacctgcgcctcttccggaactggatctgacatgagagttatggcctctagagcatgaccttcctcttgatgttgctgctcatcttcttctacatttttgctgtgactggtgtctacgtcttctcagagtacacccgttcacctcgtcaggacctggagtaccatgtgttcttctcgtaagcagagctggggacagctgggtgaggggagaaaatttggctaagagaccaggaagcttgtccaaagtatagtaatataaaaagtgcagtctattccaagaaactgaaatagaacacaatagggagagggaaagagaaagcaaaagaatagtgaatggtattagctctgatcttgaggttagggcagctagttccatgtttattctgggttttgcaaattcaaaccacactgtcatcaggcatctttaaatagcagtacactccagtggttaagcttggtttctgtgactcagttacctcttttgaaaaatgggggcagggcg

SEQ ID NO: 155 - DNA, 6308 bp, Homo sapien
gcgggactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcaccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggcctcccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttggtaaggatagagatcctgagggttcgtttagtgggatgaagaatgtgcctaggtgaatcgaaagaacaagttaacatttacttaacttctttcttttgattttttttccctaaaactaaacatcaatcattgcaggagttgttggtattaggagcaaagtagactaactacaacatcaatgccaacaagagcatctgccggttactgagcacttactaagtgccaagcattattttaagtgttttccttacattatctcatttatgctccacaacaacccaattaaataaccatgaattttatccccctttttatatctgaacaagtttaagtatagtgtttaagcaacttaatatagaaaggctgaatagtaagcacttctcagagaatgctattcaagggataacgcccagggaacaatgaagaggataagatgaagaagctgcaattctgcctgggtgccttggggtgtattttacttataacctgtgtgttttccacagtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaagagcatgaccttcctcttgatgttgctgctcatcttcttctacatttttgctgtgactggtgtctacgtcttctcagagtacacccgttcacctcgtcaggacctggagtaccatgtgttcttctcggacctcccgaattccctggtaacagtgttcattctcttcaccttggatcattggtatgcactgcttcaggacgtctggaaggtgcctgaagtcagtcgcatcttcagcagcatctatttcatcctttggttgttgcttggctccattatctttcgaagtatcatagtagccatgatgggtaagcatagaggaggtgaaacttgtttgggaagtgtggttgggaaaaagttattctgaaagctgggattggtggcttatgggtataaagaacctagtgtagcaggaaggcttgggttctggattggatatttcacttggattctccccacccaagccctcttcccaagtctagtcattaccatctcccagctcctaatggccctttggggcagttactaactttcagaatatcaggaaagagctgaatgaggagatggcgcgtcgggaggttcagctcaaagctgacatgttcaagcggcagatcatccagaggtctgcttctcccttttcaaccccaactttccttctcaagggtttcctgagctcatttcttgtttctacttctcgaccccacttttccctttgtgacagtagatttgcccccaaggataagaattctccagctctagaatattgcctgattcttcatccactgtggggtgtcctccatttttttcaccccttgactacaatttgttctccccaattagttttcttcactttctgatatgaactttttttttcttaccacacttttgcttgaatataactgtctttgctcttttttttttttgctctgcaggagaaaaaacatgtcacatgaagcactgacgtcaagccatagcaaaatagaggacagcaggttaggagtatgtatgtgaactgggatagaaacacatgaaggaggagagggtggaaaactaaagatgaagattggctttgagagataattcattcatttaataactgcatattgtagtaggttgactagtggcacccgaaataatatgtccatgtctttgctccctggaacctgtgaatgtgaccttatttggaaaaaaaaaaagatcctaagttaaggatcttgagatgagatcatcctagattatccagcaagaggagctagtcaacaaagggaaagtttggacttatcagaagtgtctgaagtagagtctaattatggtgccactgaagaggatttaataacatctgcatcaaaaacagaagagaccttgtcaaaaaagagagagtaccagtcttcctcctgtgtctcctccacatcctcttcctattcttcctcttctgaatccagattttctgaatctattggtgagccgaagaactataataatgagttttttccatttgaattcagactcctctttaagacatcttagtcttaacaggagctctcctagtatatctcctttccaattttctggtcttaattactttgtttttgcttcttaatttcccctgtacttcttcttcacttcgggtaagtgtggctgtggccctctttgctcgttgtaaaaagtggtttcttactgatgcaccctttccctccttgcttcctgttacctctttccaccccacctttccacccacaccataggatttaccagctcttacccaacttttacaaatctagacgtgcttttctgaagcattcctccctgcaggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatagaacaatgtctgttcattaaaattaaaaagtataagtgtctaggccaggcgtggtgaaaccctgtctctactaaaaataca

SEQ ID NO: 156 - DNA, 271 bp, Homo sapien
aagagtaactgtcttgttctcatctttcttcttttccttgcagcaaacagtttgtggatttgaccttcttcgtgccaatggtcattcctttgtgtgtgatgtcaatggctttagttttgtcaagaactcgatgaaatactacgatgactgtgccaagattctggggtaagagacatagtggtctgcgctggggagaatgggcttacagaagaatatttgaaagtttttgctttattttaaatatcacaaatatgatttaaaagtgaaaaag

SEQ ID NO: 157 - DNA, 424 bp, Homo sapien
aaaaaggcacaggtcatgaacatgcagtgcacggggaacctggacctcatccccttgcggggacggcgctgcaggaggtcgggagactcccccagccttccctagccattggcctacagccccgggctgtgtccaccactcacctggcatcctgcacacaggtgtccctccctacctcaccttcctgtcttgccttctgtctttgccttttgggatctaggggctcagacactatctgggtgggatgtgtgtgttttgggggttgtgtgattgggcccttgtgggcattgtaaaaattctgtttcatgtttctaggggtgagacagtggaggggtgggcttcttggttctaacaaggaatgtagtatggttgcagtagccacagctctcccatgcaaagaagagagggtggccagactcttatc

SEQ ID NO: 158 - DNA, 3665 bp, Homo sapien; identical to SEQ ID NO: 100
  misc_feature (1543)..(1565): n=a, c, g or t
  misc_feature (2711)..(2744): n=a, c, g or t

SEQ ID NO: 159 - DNA, 1269 bp, Homo sapien; identical to SEQ ID NO: 102

SEQ ID NO: 160 - DNA, 5517 bp, Homo sapien
  misc_feature (2543)..(2594): n=a, c, g or t
  misc_feature (2874)..(2896): n=a, c, g or t
  misc_feature (4157)..(4157): n=a, c, g or t
  misc_feature (4217)..(4218): n=a, c, g or t
  misc_feature (4246)..(4246): n=a, c, g or t
  misc_feature (4911)..(4911): n=a, c, g or t
ctttttatagctgctgggcactaccaggcctgtcctggggagaggagaggaaggctggattgcaggaaggatgcttcagatagattccccacatgggccatagggcagcctctgctgcctgtttcccccacctgcagtatccagattgggatgccctctcctgctccctttcctgagcccaggccccccgggcctgctgggccccagggaatctcctcaagccctcggttttctctagcgccctggctgggcctccaggagatgccctgggcagtggagcagccctgacattgtctctgcagggaaaagtttgcctgctaactcaataggagttggagctccaggcaaatccaacctgagggcagcaattttcaaaatcacattcttactggaataatgcagactgccaggagaggcgaaaagatgtgtcaggatggggcaacaggaggaaagggaccgtcataactcctcagaatgtctgcaggaggttgaagactctggcctcttgcttcccctgccccaagcaaacacttaaggcaattttcaaacaacccaaagtgtatgccaacttgggctggatatggatgttgctagagatataaaaccatcattgactgcattatgcaatctaattagtttgcatgtagtttaacctgtgtgagtaatagagctgatactaattaacttgaggcaaaatgatttttgaaggtgtctggctttccattttgggccacacctgagctttttggctgcctccaggctgagttcagcatagcccaggtggatggaaatcaccaaccccctttcacattcttgtactaagttgtcagctgatccttttgtcatggctgagaggggaaaggggttcccgattaagaataacaaacatctggacgttagcagggcttggaacctagtcacccactacaattttttaagcttgttaacaggaaacgaggagagatgtgtagtttatgtggcaaacataaaggaggtccacaatctcttccttattgttcgaaagaagtctggggaactaagtcattagctgaacagcttgcagcttcttagtcctcaaactgctgtcttgtacattgctgctttccacataaaacctcccagcacagccaccccaaattctgcctttggaagtccttaggtaatcaattaaaggccagtgtctgggcagggaagctgtttgcagaggtttggatagggattatttttctcgagtgcccctcatacctagaacgtttgcctgctgcagatatacagacaagatatctccctacctcatagccaccttcacccctgtcccacaacccaacacccagcccaccttcttggacgatggaggtagtcgttaatttcttggtatcattgctagctcttagccttacccttggtctttcaagaaaaaaaaaatgcctgatactgtcgttaacagtttaatttatgactatttgcaaaatgtggaggcctgtgtggagaatgcaaatcgcctcacaaagagataaaggttcctgttatctgattcagagggagacacacagttccgaggatgccgagggaaggagtcctgtgcaaacagatcttttagttcctgtccacagacacctctacattctgtagacatgcagagtcctagatatacatatgaggaggttgcatgtgtgtctggttcttggggtggaggtggtggtggagattttcgaatatctgttttaatgactcacaatatgcatatgttaaccccagtcttgtatggggagccctgaaaggtcaggtcacaacctgaaccgcctttaccaagaagcttctcatttcaaaggcacttactgtattttcacgtatcaaaaaagaaaagtgttttcctgaagataacagggaggggggatgcttctcggagggacctgggttttaaaaaataaaggggggtaggagaaaaagggagagagaagaaaaagggggaaaagaaacagctcaaatgaacagagagatcacggtttgcatggctgcccttcaataggctaaactgacaagatcagttttaaagggccacttaaatcagtttcaaagactggagaaaaatgagtcgccctctttggggggaatctgaggctggatcgtggacgccattactcgggactgggccaggctgtccacccccaacccccaacccctatataattataagccaaactattatttacagaggaggaggggagagagtgctggtagttttggtttcttctgtttactgacttgggccagacagacccaatgcacttttgcttgggcctctcaatgacccaggctaaggactcgggcagtgaaagcctgtagcacactgagctatgttttattttaaagcaaacacttcctcaggaccatctcttgctctttcttcccccaccccgcctcccccccttaagttttcagtacatagacatttgctccaactccggttggggcagtttgacagagctctgtgcacacacctcatgtgacccaattcaaacctcttaatctgatgactgaannnnnnnnnnnnnnnnnnnnnnnnnnnnnnnnnnnnnnnnnnnnnnnnnnnnaaactttcttccagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcnnnnnnnnnnnnnnnnnnnnnnngaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaagactgtcaaatgaacttttacagaatgcattaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtctttttttttcccaaattattaattgtcctgtgtctatgtacctctagcaacatgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaaataccattgaaatcagcatgacaaaaataacactgttggcacttataggtaacgtgattgattcagtatcttagagtttacagtttgtgttttaaaaaaactgaaggtttttttttttaagtgcaacatttctgtatactgtaaaagttataataactgaactgtttggtcgagtctttgtgtgttatattccaaggaaaattgaaagtattcagaaattaaaatattatttgatatctgaaacctggctgtccccactcactgtctttacatctagaagagcccctgtgagctctcgcttagctggccgggcggggggtnggtgggggggcatttgcttactcccctcagtcagtttgttcaaaggtggactactgtatnngcctgtttaatttgggtgtgtgtgtgtnggggggggagctgaagttaatggtttatctatggtttaggaagtgccatactgatatagtaaaccacccccattcacctaatcctccttttaattaaaaatggattttccaggaaaaaaaaaaaggcccttatatttgtcacacttaagtgcctgcttagggaaggtattgtgaaaaagtattagaaatcttgagatcagtatctattttatgatcagaaaaaaatactcttttgtacatttctgacagttactcagaagatcgttcaagcaagctaatcacagcattgtaactagaggacagttgtttgcagtgagtttttccttaagtaggtacgattttttaaaatattctgtgattctactctagcgtggttgttgagagagtttcaaattcagtgatacaggttctaagactgaaaggtctacttttaatgtatatatgataacttgcagttggtttccctctcccctccccccctttaccttcagtctgtgagagcatgaccacagggtcaagggaatcttttccattggagttatgtacataaaaacacatcgacattttgacatttcagattgtgtggctacaatctgtactgctcttgggatcctttgtccttagaagccaaattaaggaagagaaagcaggacagagaaaaaganagatggaaggagggaaactttacagggtgtgctgatttggaagtagtaactatttcttttggagtctttttttcatttttcctctttctcttttcctggtttggaggaagctcggtgctgggagcttgcaattttgttcttattcaaggtttccaacccacccccccaccgccagtacttcatcatgttgtggtttaattctaattggtgggggggggggaggactagtgagggaggtgaaagaacagggataattttgtaaagtgtattaaacgttaatattcagatccagtcaatacatgcagaccagtaaaatctgatttgtgcagagttctccatctgactctcacttatttctgtagatatatacatatataaatacaagtatgttcttacggcacagtattgctgacctttagttcgaggttttgtcggttgttgttgattttcttcctcttgcaagtgctatccatgtgagtgtgtgaagtttctctaataagtaaaacacaggcccttttccttgtttgttttgtgttagtttattgtaaacagccatttgttgtaaattattattggcattaaattataatttatgattttcaaagc

SEQ ID NO: 161 - DNA, 5688 bp, Homo sapien
gggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattcatatgttgaagcaattttttttaatgttatgttaagtcttaaagagggtggttcactttttgatggtcaaccatttagaagtcttagaactatatttcctcttgtttatacttttaacatagggtttatatgtacattaaatatacttgtgaattagtatttaatggctatttttacaaatatcaactttatgctgatagagcaaatggcatcagtgttacctttaagaaagactaacaacatccagaagatttaaattctcaaacctgtgcctctgttttaggatataagtattatcacaaagtatacttaataaaggctagaaaaatgcttttaaattatggaatctgagatcgttttcagagtgggccatcagaaagaacttagctttatactgtcaaaaaaaggctaagatggtcgagtcattttcattgtgtagtgtacttgcacgtttatttttaggacaaacacatttgaactttatgaattttttttttttattttggcatgtgaaatcttatgaatggctttcattttatacactagaatctgcctcatttactcttaacatatgtttaagtatactggtattaaaacattcaagaaaaggatattgatctaaaatgctacctgagatgcataaacatgtcatcaagtagagaaaatatttttatttttgcccaatattttttagacagtttgattattcttaaaaattgaaaacataagctaaagagatgactaaatggtagattattttgtgtgtgcatgctaggaaaaatgctgttgctttagttttgagctcttcaatgagtctaattgtggtaaggaacaatataaaatcagtttaaagatctttaaaggtagaattttaaataggcatgaaatatagtgagaacttttagtaaacatactacttactctaaaatcaaacattttattttcctaaagaatataggttgccaaaaaatattttatctctaaatataggttagctgtaattatttcatgaattttttttttttttcaatgtaactttttttggtgaagattcatggttcctaagttctgtattcaagtttttggaaatgtttatttaaaaactgttctatacaagtgttcaaaacattgtatctaaagagagtagcctggacttaaaatatttgaaatcagcttatgcgtgccttttaattttttttttaagtttcttactgccacatatggtgtgaagtgacagtaagttgcttaatgacatcctgcagtatctgcttgcttttggagactccagtgagatgttgaaattgttcctgtgcttggtaactactttcctctgccaggctatgggaaagaggatgtaattgtgaataatatacaccatccagtctttaatgtgctgcaacaatgtagtaatttgtttttttcatttgttcccactgcctttgtgtacatagaaaacttaaaaatttcccccagtctattagaagttaagatgttccctaatttattaaatatgcctttattcacaatttgtttttttaggttattcttaatgcattatagaattaagtatgactttgtttatttttattacagtatgtagttattgacatattgtggtttgcagaattatcaattgtataaactaaacctttaaattaaaaaa

SEQ ID NO: 162 - DNA, 4257 bp, Homo sapien
attgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattcaaaaaaaaaaaaaaaaaaaaaaaaaaaaaaaaaaaaaaaaaaaaaaaaaaaaaaaaaaaaaaaaaaaaaaaaaaaaaaaaaacttaagggacccgggatccaaaaagcttgatattgaaattctcgccccggggaaaataatccagggcttggggcccccctttagggctttttcccaaaaggtaattttggatgccctaattaacctaagggtctcatggct

SEQ ID NO: 163 - DNA, 1321 bp, Homo sapien
gactccttagcagcggagcagcccacggcctgcctgtactgcctgttacatgggccctctggtttgatgtcatcagtggaaatagaagcagggaactgacattctgatttggcatttgcttcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagagaggaagctggcgcgtatggcagccgaggagcacactctgcaggacactggacaagacagaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattca

SEQ ID NO: 164 - DNA, 3982 bp, Homo sapien
attgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaatttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattca

SEQ ID NO: 165 - DNA, 4055 bp, Homo sapien
attgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattcaaaaaaaaaaaaaaggaaacc

SEQ ID NO: 166 - DNA, 5688 bp, Homo sapien
attgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattttccccatggaagaagcccgtagttccatgaagtatggattaccatttgtatttttcactaacagtaaatgtatttttcttattaattgtttgccttaggaatgatgaattacattttttgttccttcttaccataaacatctgcattcctcagctcagccttccttgtatgttgtttctttataaatggttgagctgctgatgcaggtattgccaagctaacagtacaaatcattttaaagaggaagctggcgcgtatggcagccgaggagcacactctgcaggacactggacaagacagtaaatattcaacttttaatgctgattaaaggagtataggtaaagaatacgtaggtatacataattggtgagacaaatattcactttatttatattttatatattatttttttaatttggtaaatactatccagttttgtagttgtccttgttgatttgtgtgatattaaagtattagtaataattgccaggaaactatcattagggagggtttagttggttgctgtttggactgggagggatgatttaaatttagtgctagaaaccaattttagtgactgcacagtttatcatttgtcagacagaaggtagctataaagctaccctgtaagtcatatcaaaaaagttcagaggaagattagtaaatatttatcaataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgtttgctacatcataatgctggttttgctgactttttgtttttttatatatttataaaaaaagaaaaagttggtgattgcattgggaaattcccagggtattactggacctatgtggtgtattgttaaaccagtgtccttgtgatactgttgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattcatatgttgaagcaattttttttaatgttatgttaagtcttaaagagggtggttcactttttgatggtcaaccatttagaagtcttagaactatatttcctcttgtttatacttttaacatagggtttatatgtacattaaatatacttgtgaattagtatttaatggctatttttacaaatatcaactttatgctgatagagcaaatggcatcagtgttacctttaagaaagactaacaacatccagaagatttaaattctcaaacctgtgcctctgttttaggatataagtattatcacaaagtatacttaataaaggctagaaaaatgcttttaaattatggaatctgagatcgttttcagagtgggccatcagaaagaacttagctttatactgtcaaaaaaaggctaagatggtcgagtcattttcattgtgtagtgtacttgcacgtttatttttaggacaaacacatttgaactttatgaatttttttttttttttgcatgtgaaatcttatgaatggctttcattttatacactagaatctgcctcatttactcttaacatatgtttaagtatactggtattaaaacattcaagaaaaggatattgatctaaaatgctacctgagatgcataaacatgtcatcaagtagagaaaatatttttatttttgcccaatattttttagacagtttgattattcttaaaaattgaaaacataagctaaagagatgactaaatggtagattattttgtgtgtgcatgctaggaaaaatgctgttgctttagttttgagctcttcaatgagtctaattgtggtaaggaacaatataaaatcagtttaaagatctttaaaggtagaattttaaataggcatgaaatatagtgagaacttttagtaaacatactacttactctaaaatcaaacattttattttcctaaagaatataggttgccaaaaaatattttatctctaaatataggttagctgtaattatttcatgaatttttttttttttcaatgtaactttttttggtgaagattcatggttcctaagttctgtattcaagtttttggaaatgtttatttaaaaactgttctatacaagtgttcaaaacattgtatctaaagagagtagcctggacttaaaatatttgaaatcagcttatgcgtgccttttaattttttttttaagtttcttactgccacatatggtgtgaagtgacagtaagttgcttaatgacatcctgcagtatctgcttgcttttggagactccagtgagatgttgaaattgttcctgtgcttggtaactactttcctctgccaggctatgggaaagaggatgtaattgtgaataatatacaccatccagtctttaatgtgctgcaacaatgtagtaatttgtttttttcatttgttcccactgcctttgtgtacatagaaaacttaaaaatttcccccagtctattagaagttaagatgttccctaatttattaaatatgcctttattcacaatttgtttttttaggttattcttaatgcattatagaattaagtatgactttgtttatttttattacagtatgtagttattgacatattgtggtttgcagaattatcaattgtataaactaaacctttaaatta

SEQ ID NO: 167 - DNA, 194 bp, Homo sapien
  misc_feature (92)..(92): n=a, c, g or t
  misc_feature (99)..(99): n=a, c, g or t
  misc_feature (160)..(160): n=a, c, g or t
  misc_feature (179)..(179): n=a, c, g or t
  misc_feature (168)..(168): n=a, c, g or t
actcctccaagaggcgacaagttcaaagctgagtaaaggggggaaatgaaggaaacttcttgcacaaggagcttgcccaagctttttgtggngggggangaaaagtggattgaagggaggggggcttgtaaggaaagccttgatggggccagcccttggnattgaagnaaccaaggtgnaccccaggccaaggg

SEQ ID NO: 168 - DNA, 153 bp, Homo sapien
  misc_feature (92)..(92): n=a, c, g or t
  misc_feature (99)..(99): n=a, c, g or t
actcctccaagaggcgacaagttcaaagctgagtaaaggggggaaatgaaggaaacttcttgcacaaggagcttgcccaagctttttgtggngggggangaaaagtggattgaagggaggggggcttgtaaggaaagccttgatggggccagc

SEQ ID NO: 169 - DNA, 936 bp, Homo sapien
ttttacacttcaaggttctatacaaatgtaaaatatcattctattacttatttataatgctgattattctttaaatgactttaaaatgttaatctctgcttgagcctacggagaagtatgtaacaaatttgtgaaggattggcattaaagatagtcaaaataaaacatagaaattatggtaaataatttaactggtaaaataatctaagtggtagttctcaggtaagtggaaattcgattagctgattgtttaggattcttggttataagtgacagagacctgactaaaagtacatgaagcacataactgagaaggctgtggtatggctcagcagaaatgggaaaatcttgggactggttcgtgttttatttacattatctttgttcccaggcagtctctgcatgtaagtggcaaagatgactgtctgaaaatatatacctacttttttaaagggctatctcaagccattctggagaagcaccaaaagccactttgcttatactgggagaatagtttgctttccctaatttgtgatgagtgaaacactgaacagagacatagaataatattctgtagttcaggggttggtgtaatatggccagtgggcggaatctggtcctcagactgattttgcaaataatcttatagaaacacagcaacacccattcattacatgttgtttatggttgctttggggttacaatggcagagttgagtagttgtgacagagatcactaggctcaccacatctgagatatgtactgactgaccctgtacagaaagtttgctgctcttagaggaatgtgtgtttctagtgtcagcaataaacttcttggatttgttttgttttctcatctttacatgatagttgcagactagttgatccttgtgacctgtttttgaatgccactgtgtattctgtcagggccctctga

SEQ ID NO: 170 - DNA, 914 bp, Homo sapien
gccgcctctttgtctgctccgggacttggaacaaaagggggaactctgatgaactctctttcctcccctctcccccggacgccggggtatctccctctcgcaactttgccgccccgactttctctgctgtcaggccgggaaaaagtgtccgaacgcctcgtggactgcagcgggggaaatgtcccttaaaagtgcgacgaagtggggaagaaggtgtaattactattatcagcatctagaaagcatcatgaatttgctggagtacttcctagcactgacctccttcattctgcgttgttcttactggatctttccatcagccaacaatatggaagtaccaatacaaggtcaaatcattcctggattcatctggagttgcttaaaagttaaatcattggaatttttgatgataccttttctatatggattacaatttgatcgctgggaattctccaccttaaagaaggtcattaacggaaaaatgtagtctatgatgcagcagagctctgccctttttattttaatacattttaaatatatcacaattgtctgcactctgataaaagaatgtagagctggaattttaatttgattatcatccccaatcttcccaggctttcgcagactcttttgctatctggaaacccatgtccacctctgacttccactcaaaattgctttcctcacagtctgactgcgagagttgtgaaaaattgggatgtgcttctgaggtgggctgtggaatgccatacagaatctcgaagtcttggagtctcactctgttgcccaggctggagtacagaggttgcagtgaactgagatcgtgccactgaactccagcctgggcgacagggtgagactccgtctcaaaaaataaataaataaaaataaaaataaatacactgagtctcatg

SEQ ID NO: 171 - DNA, 5047 bp, Homo sapien
ctttcctcacagctccacggctgcatctccgtgggcacgcaagcttcccctggttacctgagctgctcctgccgtctcccgcctgggcttcgccgtggtgcacccgatcccggaatcgtgcgtctgcgccctgcgaaagaaggacctgctggcggagctccggccggggtctcctgcctcgcagctgggcgaggggacttggaggacagggtgaagctgcagaagacctggggtgggatggctagagaggacgccaaggactggggaaggggaagttaggaataccttacatccaatgcccacccgtgctccgcagggcaagggcagccgtcgcctcggccgcgtgcacccagctcaggctgttcccagggatttagtctggggggacaacccatggcgagatgtggtggcattttacctcagagtggagctgaagatggataaacaaggtatctgatgtatctgcctgagaaggcagagctggagaaaggcggagcgagggagcgcgtgaaaagaaagagatgccgaatgccgggtgattgtctgccgcttgctgtgcattctcattctagggaggatggcataatttataacccagcacatggatagaggaactgtaaattgtagtctggatgtccccggcgctgtcgacgaaggaactgatgggctaggtgactgtaccagtgtccccagagaaaatcgcagcctcgcagcatggatttaaatgcatgtgcatgcatgtagagacatgaaaaaaggtttctgaccattttacacaggaagtctgtcactttgctggatcgggcttgattgcagcttgtgttttcagctccagttcaacacccatttcctgactagtgagacagcatggccaaagcagctgcatgcagaattttctttttactgtgaaagcaagccccctctgttttaactccttccagttctgaatgctctgtgctttgctaggaccgattgtggggttttgttttcttcttctacaaatccctgtaaacacagctgtattcagtaatggcaaaaaaattctatcctgtaaatagaaatctgatcaatttaatcaaaataaatgtatcccagatgactttgagaccagctggctaccacaggcttcagatgctaaatgctcagtggagatgaatacagtgttatatttacatgtttcagagtgccgggatcagcctataatttgcaaaaagaaattattttctaaagacgagaggtggtcctaccagctcacagctgatggttaggtacaggtgtaaatgctgttcatgtgatttggagatttgcagtgttgcatttcaaaaggcatgtgccatgaggcagagtatggctgttgttagtatggagaatgcttgcttctaacttgctgttatggagagccgaatgccctctgaatagcttctagtgaggttgagggcaggcacttgaggcttgttgtagattcagatgtgagagctggggttctccaaccccagctcagtggagtcagctcaaccctgggggtgaggaggtttcccagttgtcatggggagctcttctgggacgcctgtctggcccttccactgtttgttactaattctacaaaggcagctctgtgtgttggattatgtttggccagctgttgatgcattcctgcggatggggctgggtgaggatcttattactgtactttcaaactgtagatctgtgtgcagggatagtacagaaggaaaggaaaagcaataagttacagaatctgatcattcttacctctttctccagatagtcctagagtgaatccagaaaggctttaaagtgaaaagaggaaagagagagtaagtgattgggggtgggtggcatgaggagaagagaatgaaacagagcaagcgcacaagagaaaaacagccttagaacttcaaagctgcatagacaagcagaatgtcaccagcttgtaattagcggttcatggttgcgtcagtgactgtatctatccaagaataactatgtgatatgtgccacaaagtgaagaagatagtcataactaagttatcaaacccagttcaaacaagggcaaatggattaagaaattttctgtttgtaaatcaaatactgatggattacacagataagacttaactgaattctgcgtaattgaaggctgaattatcaatttgtcaggggggatatgttcattaaatgaaactgtgaacgcttaaacatgcaaattaatcatgcgagaaaatatcagtgcaagctctatcaatacaagatgttttactaaatagccaaaaatggcactgccagtctcctatctctgtatccacacataaatttttttgtttgtttttgtgcatttcaatagagagaagtcaaaagttacattcgagtaaatagggtaaattaaattctaaaattcccactttagaatttaaaaaacaactaaggagttttgatttttggtgatctcccgagtttaaaccttgaaggagcttttgctgtcttgaagccaaacagcagctagtcagtaatcgttatgggaagtcagggtaccacagttgttgagatttcaaggccacgttcacttccctcccttgtctcttgtgcttggagatttgggtgctactacagcctccacaaagagacagtgggaggagctgattggtccgtaggcttagaatgtttactcttatttgttttcagtgctcctccatggcattcattttctgtttgtatttgtgttcatgctgcacaattactcctgacctgctttgtttctctgcccaaagagaagtcaattttagttcagctctgtgtgtttagcttgctgggtaatatgtgcatatgtattgcattacccatgtatgcatttttctttttttaaaatgtggattagggaaaattgtagcatggaaagctgcatatattaaatcaatagctttttgaatcacatgtaatataatttaaatatactcactttgaggttgccaaaactgacattgtctgagcccgtttaatttacatcttcgatttagtcaagaagcggaacctgccagatcagaatagtgtattctgtgcacccaacagggtggaagacattattttgtttgtgttagttcaaacagctggtcattaatgcagtccccatttctagagcgaagtgctgctggacatgaatgcccgcctgattaatgctgcccctccgagggtccttcacccagcagtcatgctcgcagcagaataatgtagcatgatgtgattgcactctaacaggatagtatgtcattgtgtcaccaagcaattgaggttattatggggcagggcagacagacgggacagtggggttactagaccgtagcatttttagaaatacaggcctgacctacttagagttattctctctggctggcagctgcatggtacataaagtctcctgataggctgagtctgttgctagggggaattagcatgaatttttccacacacagactcagtggctgaatgataaaagctgactggaattaaagagatttggtttagtattatacagatttatgtgcctccttttctttctcaagtgcagagaaagagtgcaaaacacagattttgtttccatttgttctttgaccttcttgttctctccccctcccctcaagatgcatgaggggaggagggcagggcagttatgaaattttggttaatctctcactgttggggtcactgaaacgatgtcgcaaattgcaagatatttaagcttaaaaactgttgggaatgactaacagaaggttagattatttttcctcttctgtgcactaagctgttttgaagttgggcatgcatctttcatgcactgtatatttaaactctctttcccttttgggcttgaacaaaacatttatataaattcttttctatccaaacagattgaagcttgcaatctctgtcttgtttaaaacaaggtggtcaggattccagatttagataggaaaaatatatatataccatttttgttattacaaaatattattttctggggtattgtgggtttggctcccttttcaaaaaccagcctgatgtggatgcttatggatgaaactgaactgctcctaccctaccctgttggcttcacaatgtataggaaaacataggtttttctccagaagaaaatctgcctgcagaatgtatctggaggttgttttccttgttgctgacatatgcactgcatgtagacaactcacataatcaactgtataagatgacccatttttttccttctcatggatctccaagtgtctgtggcttttaatagatcttttctagaggaggagtcttgatagatctttttaaggtaatctgaaaagccatcaggagaaaaattaaagcaacacatatttaagaatactttaatttttcttgttcttaattatatgctaactgtgcttaaactgcaatttctttctgttaccttttactgctgaaagtagtgattatccttgccttttagatttgaaattaattttcgtgagaacaccctgggatatcacaagtaaaaaagaaactgggctacataaaggaaaagaataatagagattcttgtaaacttgtcacattagttttttttgcccacgtgaaaaaggcaagagaaaatttaggtgtagatttttcttttcatttacattttaaaaaatatttggaactatttagatacataatgctttaaaacagtgattcctacttatagcggagactacagtcaaaacaaaataaaacaaatcctctaatgctatcagagccaagaaatctatcaatcatatatacattttttaaatccaggagtgtttacatttcagcatataaatcttatcaagctaaaatagagtatatattctgatgttgtaattgatagatcataccctcactggctttgagagtccccaaacatttattgtaaaggtttccaactacactagcaatcttttgtaattgaataaaatgccaatttatatttgttgaataaaagattatctggggtactgctccttccgaaatg

SEQ ID NO: 172 - DNA, 756 bp, Homo sapien
gccgcctctttgtctgctccgggacttggaacaaaagggggaactctgatgaactctctttcctcccctctcccccggacgccggggtatctccctctcgcaactttgccgccccgactttctctgctgtcaggccgggaaaaagtgtccgaacgcctcgtggactgcagcgggggaaatgtcccttaaaagtgcgacgaagtggggaagaaggtgtaattactattatcagcatctagaaagcatcatgaatttgctggagtacttcctagcactgacctccttcattctgcgttgttcttactggatctttccatcagccaacaatatggaagtaccaatacaaggtcaaatcattcctggattcatctggagttgcttaaaagttaaatcattggaatttttgatgataccttttctatatggattacaatttgatcgctgggaattctccaccttaaagaagactcttttgctatctggaaacccatgtccacctctgacttccactcaaaattgctttcctcacagtctgactgcgagagttgtgaaaaattgggatgtgcttctgaggtgggctgtggaatgccatacagaatctcgaagtcttggagtctcactctgttgcccaggctggagtacagaggttgcagtgaactgagatcgtgccactgaactccagcctgggcgacagggtgagactccgtctcaaaaaataaataaataaaaataaaaataaatacactgagtctcatg

SEQ ID NO: 173 - DNA, 2868 bp, Homo sapien
ctttcctcacagctccacggctgcatctccgtgggcacgcaagcttcccctggttacctgagctgctcctgccgtctcccgcctgggcttcgccgtggtgcacccgatcccggaatcgtgcgtctgcgccctgcgaaagaaggacctgctggcggagctccggccggggtctcctgcctcgcagctgggcgaggggacttggaggacagggtgaagctgcagaagacctggggtgggatggctagagaggacgccaaggactggggaaggggaagttaggaataccttacatccaatgcccacccgtgctccgcagggcaagggcagccgtcgcctcggccgcgtgcacccagctcaggctgttcccagggatttagtctggggggacaacccatggcgagatgtggtggcattttacctcagagtggagctgaagatggataaacaaggtatctgatgtatctgcctgagaaggcagagctggagaaaggcggagcgagggagcgcgtgaaaagaaagagatgccgaatgccgggtgattgtctgccgcttgctgtgcattctcattctagggaggatggcataatttataacccagcacatggatagaggaactgtaaattgtagtctggatgtccccggcgctgtcgacgaaggaactgatgggctaggctcacaggcagaaggaattttccttgtcttggatgagacttttgacttggacttttgggttaagttctggagaccagaaggccaaaatcaaaagtatgggcaggcttgatttctttagaagactccagcggagaactgtgtctccttgcttctgattctacatctccatccatgggccactgtttcagcaacctcagccagtgcaacacaacctcagccaagaagagtatgcagagaaaggagtcccctacctgccacaaaactgttgtctgaaaactgtctcatattgtctcaagttgtcattcattgtgaattagacctgtttaacatgtaatctgcaacatgcttcactgtctaattttccagagcccctcatataaggaactgtattattggtataatcatcatggtgaagaagttggtatgtgggggagagatgacagaaacagagagtaagtcagagctggctgcctgacagataaaaaggaaatgaccaaaaaaaaaaaaaaagacacagaagaatactttgttgtccacacagaaaagggaagtgtaggtaagacagcagtagactaagattcttaagactcaagttctagtcttatttattagctatgggaggccttgagggagttctagaattaagtgatctctctttataaaataggaacagtaataacttcctggctaactccctggctgtctcacaatgctgtagtagtaagaaataattttataattaaagactattttagggctgattacatttttgggcagtggctcatacatgtaatttcaacattttgggaggccaaggtgggcggattgcttgagcccaggaattcaagaccaggctgggcaacacagaccttgtcactacaaaagaaaaaaacattagctaggcgtggtgatgtatgcctgtggtcccagctactcaggaagctgagacaggaggatcacctgagcctgggaggtcgaggctacagtgagccatgatcacactactgcactccagcctgggaaacagagtgagactctgtctcaaaaaaaaaaaaggaatattttacacttcaaggttctatacaaatgtaaaatatcattctattacttatttataatgctgattattctttaaatgactttaaaatgttaatctctgcttgagcctacggagaagtatgtaacaaatttgtgaaggattggcattaaagatagtcaaaataaaacatagaaattatggtaaataatttaactggtaaaataatctaagtggtagttctcaggtaagtggaaattcgattagctgattgtttaggattcttggttataagtgacagagacctgactaaaagtacatgaagcacataactgagaaggctgtggtatggctcagcagaaatgggaaaatcttgggactggttcgtgttttatttacattatctttgttcccaggcagtctctgcatgtaagtggcaaagatgactgtctgaaaatatatacctacttttttaaagggctatctcaagccattctggagaagcaccaaaagccactttgcttatactgggagaatagtttgctttccctaatttgtgatgagtgaaacactgaacagagacatagaataatattctgtagttcaggggttggtgtaatatggccagtgggcggaatctggtcctcagactgattttgcaaataatcttatagaaacacagcaacacccattcattacatgttgtttatggttgctttggggttacaatggcagagttgagtagttgtgacagagatcactaggctcaccacatctgagatatgtactgactgaccctgtacagaaagtttgctgctcttagaggaatgtgtgtttctagtgtcagcaataaacttcttggatttgttttgttttctcatctttacatgatagttgcagactagttgatccttgtgacctgtttttgaatgccactgtgtattctgtcagggccctctgattctgtttcttatggtgctgaatgcacaatttaatgccctggaatttccttctgtcttctgctaaactcatgcctcttcagatagttaaaatcctgttctaccttagaagtctccagagttattttcctaaattaagaagaactggctttgaagttactcattatgccacacacaatggttgaaaagagcatctcttat

SEQ ID NO: 174 - DNA, 606 bp, Homo sapien
  misc_feature (61)..(61): n=a, c, g or t
gccctatccgcgttcatccgcgccttcaggtgccccgccgagggttcggatcctgtaggcnagccgcggacccttgcgccacctgcgccgcggggcatttctcaaggcgggtcggcctgcgggtcggccttcctaccaggtccgatcactgagagcctccctcttccaccggggcttgggtctgggtctgagctcccgtcgctctacttggtgtccgcggccctgagcgccctgtcgcttctctcccgcagcagcaaagtctctcgcgacaccctgtacgaggcggtgcgggaagtcctgcacgggaaccagcgcaacgccgcaagttcctggagacggtggagttgcagatcagcttgaagaactatgatccccagaaggacaagcgcttctcgggcaccgttcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagatt

SEQ ID NO: 175 - DNA, 735 bp, Homo sapien
caagcttgggaacacagggcgggcgtgagaagccatgagcagcaaagtctctcgcgacaccctgtacgaggcggtgcgggaagtcctgcacgggaaccagcgcaacgccgcaagttcctggagacggtggagttgcagatcagcttgaagaactatgatccccagaaggacaagcgcttctcgggcaccgtcaggttggcaccgttctgatcccacccagccctcagtgcccccgtgcttgcccctcccctgcaggctcccgctgagccggaggggggcacgtcggtactgatgtgctagggtagttcagaccctctgctccgggcaggcgcggctggacggacccccaccctgggtcttaaaacatgaggggaggcgtgggtaggcctcggccgagcccgccggccagcctgagaagccaggctggctgctggtgaatgtgaacgctccgggtaaggctcggtggctgctgcggtcccagacccttcaccggcccttgggacccagggctaggcgtaacctgttggtgctgtcccccaaaacgcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctgggtgagtccggccgctgtggttttgcatgtgagatgtgtg

SEQ ID NO: 176 - DNA, 943 bp, Homo sapien
aaatgatgaggggcctagaatagcaaaggatcggcggtggttgcctagcttgcctgagtgctgttttagctttggggtggtttgatgtttgtattgctatgaggattccagttgatgagggaggccaggcattgtaagttgaccagccaggtgctggtgaactatgatttggaaatctttacgctgcgttgtttaggcagtggcattagactgcttttacaggtaggaagcagacattcccagttgtcacgtgtccagggtccacagctaagaaataggcagaattcgagcccaggcagtcttgaccagagcatccgttgtacagcggttatgccatggatcatgggtcagcctggttttctgagagcatgttttgggaccagtgaaggtccagaggactttctggaaaccgtttgggctagggaaaagactgaggcggggtcttagagagggtgctgcttggaggtcacttacatgattgattcaagtgcgtttctggcctgccacatttgaggtgtgccttggtgaccaggttctaagcaatgccaatggcttcctctctctatcagccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagtt

SEQ ID NO: 177 - DNA, 742 bp, Homo sapien
aaagggaccaactggagctccccgcgtgcgcccctactatacggtcctaagtagcgaccatgagcagcaaagtctctcgcgacaccctgtacgaggcggtgcgggaagtcctgcacgggaaccagcgcaacgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagtt

SEQ ID NO: 178 - DNA, 199 bp, Homo sapien
ggccactccagaacagtaccagatcctgaagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatc

SEQ ID NO: 179 - DNA, 1358 bp, Homo sapien
cgccgggcggggaccgtgggggccgcggacaagcccaaggccggagcggttccaggaggaccctggtctgcacctgtggttgccaggtaggtggatgtgagagaccctacccttctggttctctagaagccatcccatcgccgctagcatcatgctgtcccctcagagagctttactctgcaacctcaaccacatccacctccagcacgtctccctgggcctgcacttgtcccgccgtcctgagctacaggaggggcctttgagcacaccccctcctccaggagacactgggggcaaggagagcaggggcccctgcagtggcaccctggtggacgccaattccaacagcccagctgtgccctgccggtgctgccaggagcacggtccgggcctagaaaaccggcaggacccgtcacaggaggaagagggggctgcctctccctcagacccaggctgctcctcctcactcagctcctgctcagatcttagccccgatgagtcccctgtctcagtctacttgcgggacctccctggtgatgaggatgcccaccctcagcccagtatcatccccctggagcagggctccccactggcttcagcaggccctggcacctgctcaccggacagcttctgctgctctcctgattcctgctccggagcttcttcttcacccgatcctggcctggactcgaactgcaacgccctgaccacctgccaggacgtcccttccccaggcttggaggaagaggacgagagggcggagcaggatctccctacctctgagctcttagaggcggatgatgggaaaatcgacgctgggaaaacggagcccagttggaagattaacccaatttggaaaattgacacagagaaaactaaagctgaatggaaaaccactgaaaacaataacactggttggaaaaacaacgggaatgttaactctagctggaaaagtgaacctgaaaaattcgactctggttggaaaaccaacacaagaataactgattctggctcgaaaacagatgcagggaaaattgatggaggatggagaagtgacgtcagcgaggagccggtgccccaccggacaatcacgtccttccacgagctggcccagaagcgcaagcggggcccagggctgccccttgtcccgcaggcgaagaaagatcgcagtgactggctcatagtcttctcgcccgacaccgagctccccccctcggggtcgccgggcggctcctcggcacctcctcgggaagtcaccaccttcaaggaactccggtcccgaagccgggccccagccccgccagtcccgcctcgagaccccccagttggctgggctttggtcccgccccggcccccac

SEQ ID NO: 180 - DNA, 2761 bp, Homo sapien
aaaggctaggtacgaggctgggtgttgaatcggccgagggtgagagaggatgtgtgctgggccttggaggaagggggccgagaccgggccttacttctgtaacgatactgtgaggcatcggaaggccagcctgttgtgtccgttttgaaggtcggtgggctagactggctggccttctaggggtgtggagacttcccaactctgcccttgtgctttcctggaatccccaatatgcccggaccccggtttactcctttgctgcgagcccttctctcccgtccagagttgctccgagcctatctgctcagtcctagcgattcctgtggggcttgggacgcgcggttcaagcaccccggaccatatggatgcagcacccatgggttctcgctccaatgcttctttcctccttggggcgtaactcagaccctgggcacccctctccactgcccaggggagacctgggttctagatttggctctgcctctactatcttcctacctcctagagcctcagtttggcttgtgtaaaataggatgacttaagggtcctttcagcccctaatcctggggtactttactctgtaccgcctccttacccagccttgtgcacgccatcttgaaggcactgagttctagcctgtttattgtaagtggtgattagttgggtctcagtcacccagccatacttttttgttccctgcgtatccttcctgtaattgtccccaagcacattccacaagagggaggggcactctgggctaaggctggggtgggagttatctggggagctgccaccatgcctctgcctttggtgcttgcccctgcagggagtgcttagtgccccctccctatgccactcccaggatgatgcccctgtcccgctggttgagatctgtgggggtcttcctgctgccagccccctactgggcaccccgggagaggtggctgggttccctacggcggccctccctggtgcacgggtacccagtcctggcctggcacagtgcccgctgctggtgccaagcgtggacagaggaacctcgagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcaggtgtattgcagacagggcccgatgcccagagggtgcccatggtagccttggcctctataggacatgctcatctagctggtttcagggtacaggattgcagcgtgcctggaagggaaagaaagcgaggaagggtgttgggaagtggggttgtggtagtggcaagaaagggcttctctgtcctgtgtaattggaagaaagggtgataaaggactgtgtgtatgaatatgggccttaagttttggggctttctccccttctgttgcctttctgattctgcccagttgtcagctggtatgggatgttgggcttgggataccagggtttcgcatatctggagaaagcctggctcatggaccgtctttgtcttgcttagagttcctatcagactgagattgggcagaccctggacctcctcacagccccccagggcaatgtggatcttgtcagattcactgaaaagagggtgaggggaggtgagggacagcgcgaaccatgtctggacagcgagggagggctcaggatgtgcattgccctcctgaggagtttctcttctccccttactcaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttaaaaaaaaaaaatcgggattctttgggggggaaaaagttgaaggcacggctactgttctgcccttttgacaggggaatcgcccaagagctatcgaccgactag

SEQ ID NO: 181 - DNA, 2371 bp, Homo sapien
aaaggctaggtacgaggctgggtgttgaatcggccgagggtgagagaggatgtgtgctgggccttggaggaagggggccgagaccgggccttacttctgtaacgatactgtgaggcatcggaaggccagcctgttgtgtccgttttgaaggtcggtgggctagactggctggccttctaggggtgtggagacttcccaactctgcccttgtgctttcctggaatccccaatatgcccggaccccggtttactcctttgctgcgagcccttctctcccgtccagagttgctccgagcctatctgctcagtcctagcgattcctgtggggcttgggacgcgcggttcaagcaccccggaccatatggatgcagcacccatgggttctcgctccaatgcttctttcctccttggggcgtaactcagaccctgggcacccctctccactgcccaggggagacctgggttctagatttggctctgcctctactatcttcctacctcctagagcctcagtttggcttgtgtaaaataggatgacttaagggtcctttcagcccctaatcctggggtactttactctgtaccgcctccttacccagccttgtgcacgccatcttgaaggcactgagttctagcctgtttattgtaagtggtgattagttgggtctcagtcacccagccatacttttttgttccctgcgtatccttcctgtaattgtccccaagcacattccacaagagggaggggcactctgggctaaggctggggtgggagttatctggggagctgccaccatgcctctgcctttggtgcttgcccctgcagggagtgcttagtgccccctccctatgccactcccaggatgatgcccctgtcccgctggttgagatctgtgggggtcttcctgctgccagccccctactgggcaccccgggagaggtggctgggttccctacggcggccctccctggtgcacgggtacccagtcctggcctggcacagtgcccgctgctggtgccaagcgtggacagaggaacctcgagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcaggtgtattgcagacagggcccgatgcccagagggtgcccatggtagccttggcctctataggacatgctcatctagctggtttcaggagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttaaaaaaaaaaaatcgggattctttgggggggaaaaagttgaaggcacggctactgttctgcccttttgacaggggaatcgcccaagagctatcgaccgactag

SEQ ID NO: 182 - DNA, 261 bp, Homo sapien
aaaaagaatggaacaacttcagtaagaagaacatttttcattttagatttctatgccttattttactagttgattccaggcgtgaattccaagaagaaccaaatgtattttgactggggtccaggggagatgctggtatgtgaaacctccttcaacaaaaaaggtagggttttttttcttccaaattatccatcttggcacatttggttgtttttctgtttattacctcagattttactagttgtggactgaaacagttga

SEQ ID NO: 183 - DNA, 3633 bp, Homo sapien
gaaaaaaaaaaagaaaaaaaacaaaaaacaaaaaatacatcacaataagaggccgaatgtaaataaagacgagggacgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactgtaagggtaccccgaacaggcttgctcgtccttgcgggttgagaactgcgtctgcttagttacttcaggcttgtctgcttccctagtggtcgcgaggcgctcgtccccttccctcgactcagttgccacttttccggaggtcgcagtgttaacgagttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcaggaataaaacagatttgagcagaagaagtctgttggatgcagggagtataaaaggggaaagcatcctgctgtttccagtggcagaagagaaagagaagtaccatgaagaggggtgaacaacatcactctcgtgccggacacagacaaggaatgattaggcttgcagtcccccagtctcagcctctctccactctcacaagcaggaagggatctgagctctgttagtgggaaatcttggagtttgcatttctctgatcacgaggctacctcctatcctgttttgaaagaggaacagaaaagcagagcttgtcccaggaattgtgaaatgggctgcaatgtcttcagaggcagtagcagttttaggaagtgtgccctcctgcctctggggaaaggttgaattggggtcttgtgggcacttgttttctcatgggatgtatcagtcagacccatgcacagttctgggcggcagggaagtgtgtctctttctggacttgagccagtgagctgttggcatgcctttttaaaggcattagaaaaaaggtttctttcttttttttcctttcctgttcacaccaccttcatatgaacatggagaagggaggtttctaagtgggcccctgatttactcctatgtcaataatcgtgccagaccctaaggggcagaaaaggcagccaggggatcctgactcagaggctgtagttcgtcagccctgctaaagggccaggggtttgtctctcagtgcctgggtgggcatgcttgactgctaaccccttagctgaaaggagatggcaggagtcctccacagggtcccttcttccctcctggcttacagcttcctctgaagacgggccagttccttgctgtctggcaagaggaaacagctggggtgcacttcactgggagttgggcaagatgtcggcagtttcctggtgcccttcaagtcctccaaaagtatcgagctaaaagaggtgacaagtcttccttcaataaccaagaagagttccagcttaatgtctgctgaatctagaatcttctgacttgtattttggcccagcccacaatcttggatgcagggtgcagcagtgtttacaaacctcacaccccatttccagaatagcaggtagaggcactggagctttgattactccagagcccccaacaagcaagatggggcctggcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatg

SEQ ID NO: 184 - DNA, 2589 bp, Homo sapien
gaaaaaaaaaaagaaaaaaaacaaaaaacaaaaaatacatcacaataagaggccgaatgtaaataaagacgagggacgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactgtaagggtaccccgaacaggcttgctcgtccttgcgggttgagaactgcgtctgcttagttacttcaggcttgtctgcttccctagtggtcgcgaggcgctcgtccccttccctcgactcagttgccacttttccggaggtcgcagtgttaacgagttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcttcctctgaagacgggccagttccttgctgtctggcaagaggaaacagctggggtgcacttcactgggagttgggcaagatgtcggcagtttcctggtgcccttcaagtcctccaaaagtatcgagctaaaagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatg

SEQ ID NO: 185 - DNA, 2695 bp, Homo sapien
gaaaaaaaaaaagaaaaaaaacaaaaaacaaaaaatacatcacaataagaggccgaatgtaaataaagacgagggacgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactgtaagggtaccccgaacaggcttgctcgtccttgcgggttgagaactgcgtctgcttagttacttcaggcttgtctgcttccctagtggtcgcgaggcgctcgtccccttccctcgactcagttgccacttttccggaggtcgcagtgttaacgagttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcaggaataaaacagatttgagcagaagaagtctgttggatgcagggagtataaaaggggaaagcatcctgctgtttccagtggcagaagagaaagagaagtaccatgaagaggggtgaacaacatcactctcgtgccggacacagacaaggaatgattaggcttgcagtcccccagtctcagcctctctccactctcacaagcaggaagggatctgagctctgttagtgggaaatcttggagtttgcatttctctgatcacgaggctacctcctatcctgttttgaaagaggaacagaaaagcagagcttgtcccaggaattgtgaaatgggctgcaatgtcttcagaggcagtagcagttttaggaagtgtgccctcctgcctctggggaaaggttgaattggggtcttgtgggcacttgttttctcatgggatgtatcagtcagacccatgcacagttctgggcggcagggaagtgtgtctctttctggacttgagccagtgagctgttggcatgcctttttaaaggcattagaaaaaaggtttctttcttttttttcctttcctgttcacaccaccttcatatgaacatggagaagggaggtttctaagtgggcccctgatttactcctatgtcaataatcgtgccagaccctaaggggcagaaaaggcagccaggggatcctgactcagaggctgtagttcgtcagccctgctaaagggccaggggtttgtctctcagtgcctgggtgggcatgcttgactgctaaccccttagctgaaaggagatggcaggagtcctccacagggtcccttcttccctcctggcttacagcttcctctgaagacgggccagttccttgctgtctggcaagaggaaacagctggggtgcacttcactgggagttgggcaagatgtcggcagtttcctggtgcccttcaagtcctccaaaagtatcgagctaaaagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagrcctgtggctgcctgggggtccggctgtctggtactagctttttcataccggcgcctcgcgggggcccttttacgcg

SEQ ID NO: 186 - DNA, 2267 bp, Homo sapien
gaaaaaaaaaaagaaaaaaaacaaaaaacaaaaaatacatcacaataagaggccgaatgtaaataaagacgagggacgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactgtaagggtaccccgaacaggcttgctcgtccttgcgggttgagaactgcgtctgcttagttacttcaggcttgtctgcttccctagtggtcgcgaggcgctcgtccccttccctcgactcagttgccacttttccggaggtcgcagtgttaacgagttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcaggaataaaacagatttgagcagaagaagtctgttggatgcagggagtataaaaggggaaagcatcctgctgtttccagtggcagaagagaaagagaagtaccatgaagaggggtgaacaacatcactctcgtgccggacacagacaaggaatgattaggcttgcagtcccccagtctcagcctctctccactctcacaagcaggaagggatctgagctctgttagtgggaaatcttggagtttgcatttctctgatcacgaggctacctcctatcctgttttgaaagaggaacagaaaagcagagcttgtcccaggaattgtgaaatgggctgcaatgtcttcagaggcagtagcagttttaggaagtgtgccctcctgcctctggggaaaggttgaattggggtcttgtgggcacttgttttctcatgggatgtatcagtcagacccatgcacagttctgggcggcagggaagtgtgtctctttctggacttgagccagtgagctgttggcatgcctttttaaaggcattagaaaaaaggtttctttcttttttttcctttcctgttcacaccaccttcatatgaacgatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatg

SEQ ID NO: 187 - DNA, 548 bp, Homo sapien
ggtctcgaattcctgacctcgtgatctgcctgccttggcctcccaaagtgctgggattataggcaagagccaccatgcccggccacagaaaatttttttagagtagattcacttttggagatgatcataatagatgttaaattttttttttctgtttggtttcagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccaggtaggcatggaatatctcaccataatctcataggt

SEQ ID NO: 188 - DNA, 1359 bp, Homo sapien
gaaaaaaaaaaagaaaaaaaacaaaaaacaaaaaatacatcacaataagaggccgaatgtaaataaagacgagggacgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactgtaagggtaccccgaacaggcttgctcgtccttgcgggttgagaactgcgtctgcttagttacttcaggcttgtctgcttccctagtggtcgcgaggcgctcgtccccttccctcgactcagttgccacttttccggaggtcgcagtgttaacgaggtgcccgccctagggtcgcagtggtcgcggggtttctgccaccagtcacaaaccccggcctcgaaggtcccactccgtccctttccttcctttgtgttcctggcctttttacttcccttgcttttcctcttgggcattagagtgggttcagcccaagcagaggaatttatatttttattccagccgtattaagctctgcatcgcggcacattgagcttctgcctgtgtggcctaaggtttattcaacgtattatctcaggagactattcctgttttatcgctgtgcattcaattccatttgaactttgaagacagtatgtcaactgtggatgatctgtgatgtgtataaaaaaaattcacgcgcttttttccaaagatggttttgggaacatcactagttaaagaggaaggagctagcaggaggggcaaaaaaagggaggttaggcagtgaggaggcaaatgattacattcttgtgagtcggtgattagcctcagtaaatctgcattttacctgtgaaaagagggagcagaggaaaattttatgtatgcattcatctcagggtaggtagagggattatggttattattactgttattttttagacggagtctcgctctgtctcccaggctggagtgcagtggcgcggtctcggctcactgtaacctccgcctcccgggttcacaccattctcctgcctcagcctcctgagtagctgggactacaggtgcccgccaccacgcccggctaattttttgtacttttttgtatttttagtagagacggggtttcaccgtgttggccaggatggtctcaatctcctgacctcgtgatccgcccacctcggcctcccaaagtgctgggattacaggcgtgagccaccgcacccggccgatttctggtcttttacttgtgaagat

SEQ ID NO: 189 - DNA, 415 bp, Homo sapien
  misc_feature (277)..(300): n=a, c, g or t
ctttgctgatatttataatttggtatcataagaatgttttcctctacagtatttgtcatgccagtttataacaaaaaaaaatgcagggattttatttctatgggaaactttacagctatgttttactttgggacagaatttttatttgtatagagtgcttactaattgttaaatagttcagagtatataactatttactttaaggactcatggtaggtttaagggtggaaatgagttggtgtcatttcaattacaaagataaaagtttgccatatannnnnnnnnnnnnnnnnnnnnnnntggtagtgtacatagtagtcatcaagtcttttgacagaagtatatttttaaagaattcatctgtgatgaatccataatgtctggaactttgctgagacttgagtgggcccagttt

SEQ ID NO: 190 - DNA, 1043 bp, Homo sapien
ggtggtttccttttttggcagccagttttggttttgttgagcatgaaatctctgctcccttaaaaaattattctcggaaaaagatatcccccccgttttccaggttttgagccgcctctccttagggcctggtcgggggaggaaaagttgtaaacaaattgccaccttaaattcgcggtgcgagtctgcggagctgccgggttcattgtgtttacgaggctcgctgaaatgtgtggaatccagggaaggcgagcacccagacgggggcccgccggggccgcggccagcgccggggaaatgccgcgccggggagcagcctgcgccggcctgagcccttccctttgcactcggctgttttttacgtttaaccagaaaggaagggagaggagggaaagatccatgtggctgccctcttccgatcacaaatattgtcgtaagttgcagctggctgccccacttcctaattcagctcacacagcctctccccacgctatggaaatgcgtcgggagtgaactccggcggccgcgctcaccacgtggatccccacttactaccattctcggcgggggtccagttgggggaacccgcaatatgttgttccaaagagcgctcgcccctagcgcccgtccccgagggtgatggacagagcaggactggtttgctggctcctgaaccttgggctccatcgctgggattacgcagcccctcccttctcagctctggggtgaatattgtctgtgtcgagtggtttctctcctctctacctcggcttcctcttctgtattgcagccccagtgccccaagtcgctcagggatcccgcgggtgggggcgccctgatgtccccgaggtgcagctcccacgctgcggcccggctttatgaccgagccccccatgacgctcagatccgccggggctgcagtctcgagggcgagtccgtgtgccgcggccacccgcgcccccacggctgttgggggctcaccgggcgggtgcgcgcaagcgggcgtgggcgcgcgggccgcgactccccggcgctcactcctc

SEQ ID NO: 191 - DNA, 955 bp, Homo sapien
  misc_feature (564)..(588): n=a, c, g or t
cggctcgaggtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtgagtgagagtattagtggtcatggtgttaggactttttttcctttcacagctaaaccaagtccctgggctcttactcggtttgccttctccctccctggagatgagcctgagggaagggatgctaggtgtggaagacaggaaccagggcctgattaaccttcccttctccaggtggccnnnnnnnnnnnnnnnnnnnnnnnnncaggtcgggctaagcggcggatgcagtacaaccggcgctttgtcaacgttgtgcccacctttggcaagaagaagggcccaatgccaactcttaagtcttttgtaattctggctttctctaataaaaaagccacttagttcagtcatcgcattgtttcatctttacttgcaaggcctcaggcagaggtgtgcttctcgcggttggtggtatgtccccctaggagaacagtgaggcagaaaaggcagaagcctttggtatggggggcagaaatgtgtcaactacaagagaaatttcctgttgatgaaacagctacagatcctggggggcttcagatgtacaattggggttattcccctatccctaagta

SEQ ID NO: 192 - DNA, 260 bp, Homo sapien
aattcaagcttctaacgatgtacggggaaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcag

SEQ ID NO: 193 - DNA, 187 bp, Homo sapien
aacacaccgtgaactcaagattcttccagtgcgagatgtcacctgtagtggtacgaagtaaactcatgcagatgcagcattcctgcgtctgtggggaccctctggccggagggctccctggtgtgcttcctgcacaccgtggacaggtgactgtatggtatgagactgtgatcggtgggaacttttg

SEQ ID NO: 194 - DNA, 2206 bp, Homo sapien; identical to SEQ ID NO: 43
  misc_feature (1423)..(1725): n=a, c, g or t

SEQ ID NO: 195 - DNA, 600 bp, Homo sapien
cacagcgggacgacgagcgaaacagcagtcaacagagagcagcatactatcacgatctacgctccagcccaactagaatacagccaagcacgccaccggtacaggaacgagaaatgcgagacgagcagagaactcacagctcaccaccaaacgagacgcgcacaacatcccgcgccaactcccacacagcaaatacaagggcgactaaacaggacaagcgagaacagacaccactgcttgaagccaaacaaaggggacaacaagagcaaagaacacacgcgaaaccacgcaaccatagagcccgcagctctgcagggcagttagaaacaccaaaaagggcatacagcacccccacaggacagcaaagacaatcaacagacacaaccagaacgcagacacaagaaaagaaagatagggagaaacacccgcgaaccaggacaaaaacaacaacaacacaggacggaacaccccacaggacaacaactaccacagctagcgcaagacaactggacacaaacccagagacaggctccgccgcgacacgccgccaagcaaaaaccacatacagagaagcaagagagcacaacacaagacacacaa

SEQ ID NO: 196 - DNA, 4213 bp, Homo sapien; identical to SEQ ID NO: 95
  misc_feature (1239)..(1239): n=a, c, g or t
  misc_feature (1253)..(1253): n=a, c, g or t
  misc_feature (1259)..(1259): n=a, c, g or t

SEQ ID NO: 197 - DNA, 6537 bp, Homo sapien; identical to SEQ ID NO: 96
  misc_feature (3557)..(3557): n=a, c, g or t
  misc_feature (3571)..(3571): n=a, c, g or t
  misc_feature (3577)..(3577): n=a, c, g or t

SEQ ID NO: 198 - DNA, 1853 bp, Homo sapien; identical to SEQ ID NO: 36
  misc_feature (502)..(502): n=a, c, g or t

SEQ ID NO: 199 - DNA, 564 bp, Homo sapien
ccccgcacgcgccccagcagcccagcaaaccaaacccgacgccggcacaccaccaccacgaaccacccgccgaccacaaccgccccccggggaggacaccggccacagaagagaggggccccaccgggtggcacgaccggaagcggagtggcaccgggcggaccacccggtgagcaagacgccagcgcagcaactgcacgcggacagggagcggaagacgcgcggcacaagcggagggaggccagcaccgaacagacacaacagagccgagcagaaggaacgacggggcgccgaaagaagctgacaaccgagcaacggagccagacagccagaagagggcgaaggatcgggagtgcgagcggacagcacaggacgcaaaagcagaaggagaagaggagggaggaggagaagaggggggagcaagaaggtagcaaggcgaaaccgcaggagaggggacgcgcgcagggacagagcgagccgccgcaagcaagcccaccacgcgagagcgcgggagcacgccgcgcgacctgacgcacacacagccgcagtcgcacgcgcatccgg

SEQ ID NO: 200 - DNA, 277 bp, Homo sapien
accgacaggcacatatcacagatacccaggcgtccaacaccccagagacaacgcgtcacgatacggtgcagcaactacacttgtatccgagaacaccactgcacgacataaacccagggataaccacaggaccaggccatcacgctgccactttccgacgcaaggcggtaggaccggcaacaccgtcagtcaagactacacagaatgccaagcgaatcctccacgacacaggaccacagggctccgagacggcaccgaaagacagggctcggcttgc

SEQ ID NO: 201 - DNA, 674 bp, Homo sapien
cgtcgctggcgtctctccataggcacccgccaccacaagacgagcatccccaaccacacgacacgcacaacgacacccctcgccgaccccccgcccccaacaccaacaatacccaaggctactccgccctggcactcccccctcggcgacaatcctccctgatccgcgagacgtgcagcatcactagggccccacacgcaccacgaccgacaccccgctgcgcgcaacacgggcgcagcccgagtgactcaaccgccaacgcagtcaggccaaccacacacacgacgacccgctccgcactggcgacgccaccacgccaagctcagcaacaaccacgaccggctccgacccaacaccaagcgccacagcaccctgcagcacacgcccatggcggctcgcagcgaggctacgagagagtgccgacccagcagaggaggctgcgagcgaccggggcctggccaagcggcggggctcgccccacgcgtggaccgcccccagcgcgaccggcgcgggccgcggggacggcgccggcgcctgtcgagacttgggccaacaggaggagcgcacacgcgcgggtaggcaagccgagacggcgaggccgcgggctagcggcatgaccgcgccccgcccccccgcacacacccgaccatgggccacaggcgggcgcggccgaa

SEQ ID NO: 202 - DNA, 955 bp, Homo sapien; identical to SEQ ID NO: 191
  misc_feature (564)..(588): n=a, c, g or t

SEQ ID NO: 203 - DNA, 184 bp, Homo sapien
aatcggtaataaagcacagtttggtttgggcggtgaccagtcctcgacaaaatggtcctatcggacacaaccgaacgggtttgggcagcaatcgcatactgaaaccgtttagagcgccgacaacgaggcgaaacactccacacccacaacactaactaaaagagaacaccagcactgaattacc

SEQ ID NO: 204 - DNA, 118 bp, Homo sapien
acaacgcaacaaacacaaacccaaaaaccagagccgaccacagacgcaccacgttcaaccacacaaccagacaaccccacgaacacaccaccccccaaacagagaccaacaccacaac

SEQ ID NO: 205 - DNA, 155 bp, Homo sapien
aaaaagaaaaaaaagtctgggcggtagatcttgggtcctaaagctggttccctggtggtgaatattggttttcccgctccacatattccacacaacaacggaaccaagggtctgttcacataccattgttctggtggagacgtcagctgacacca

SEQ ID NO: 206 - DNA, 1851 bp, Homo sapien; identical to SEQ ID NO: 25

SEQ ID NO: 207 - DNA, 874 bp, Homo sapien; identical to SEQ ID NO: 19

SEQ ID NO: 208 - DNA, 2244 bp, Homo sapien; identical to SEQ ID NO: 145
  misc_feature (962)..(962): n=a, c, g or t
  misc_feature (980)..(980): n=a, c, g or t
  misc_feature (984)..(984): n=a, c, g or t

SEQ ID NO: 209 - DNA, 299 bp, Homo sapien
ggacccatccaacgataccaggagagtcatccaacctgtgacacaaccaatccgatactacaatcctccattaactgaacccactcgtcgcttacaacagtgactaaccatagacaacgacatcacgcaaacacatacaagaggatcactcactagctagccataactcgacatatgcccactgccatcagacaacactaactcatcctacaatatcccgaaatataaagcaaaacgcatacagcactccacgaacactgaccatcaaaatacaaccgacaacactccccagaacaaca

SEQ ID NO: 210 - DNA, 491 bp, Homo sapien
agtggttccaagaatgtacgaggaagcgagagaaggtataaagtatggagagggtcagtgaaaggtatcatggctgggggatatgtagaatatgtggagtagaatgggagtctgttaaacaatatagtgagtaagcgattaaatttattatcatgcgaggtattttaccagatgatgtgtcctagttcagcagtattgtcaacgtatgcaaagataaggcttactgttgattatctaatgagtcagtcaatgaaagtgatgtaaggagggcctgagagaattgtgtgccatttctgcagttgcggatagtgaactgacctggcaaaaggtttacataaataccgtactcaactgtggggagtttaaatgtctggtggctgccgtgctgagttgtcaagaaattaaagctgcaagaggactccaaggaggcaaaagaaaaaacaatatagaggggtggaggttgttaagaaatttcaattcaaaaatgccaa

SEQ ID NO: 211 - DNA, 375 bp, Homo sapien
ccgacagcgaggcccaacgcagccagaacgccgcaacgacgcacacgcaccagccacgccccacagccgacacacagaccgcaggagccgcacgccagacacagccgccccgccaccgcacccgcccacacaggcccgaacgaggcagcgaacgcagcgcagggaagacgcaggcaaccgaagcgacacgacacccagaccaaccaacgaacccacacaacgagagacaaccgaacaacaaccaggccagagacgacaccaagacacagcccggacaggcaacgaagacgccgcaaagaacgccgccccgaacaaagcagacgcaaaaggaggcagagccaccgcggcgagcgcagaaacagaggcaagcgagag

SEQ ID NO: 212 - DNA, 1052 bp, Homo sapien; identical to SEQ ID NO: 133

SEQ ID NO: 213 - DNA, 199 bp, Homo sapien; identical to SEQ ID NO: 178

SEQ ID NO: 214 - DNA, 289 bp, Homo sapien
aaacccgacaggacatactcaacgataccgaagcagtatcacccactggaaacatccctcagttgcagcctcatcctgctccagaccctgcacgctctaccgggatacgctgatccggccctcaaactccacctatcacggaacagcgagagcgccgaaccctacaataagcacccagccatgtcaaggtaatcatcgagcatagcgtgtagcgtccgtccgagaccaagcctgcgctcgatgagcctgaaacacacacgtccacgaccaaaccgcccggccgaacacg

SEQ ID NO: 215 - DNA, 415 bp, Homo sapien; identical to SEQ ID NO: 189
  misc_feature (277)..(300): n=a, c, g or t

SEQ ID NO: 216 - DNA, 610 bp, Homo sapien
  misc_feature (459)..(459): n=a, c, g or t
acccagcacaccacaacacccctgagcccacaacccaagcgccgactcgacagcatatgggcgaactgggcctttagatgcatgctccgagcggccgcagtgtgatggatgagcggccgcccgggcagggttgcacgctgcctgcatgtgtcttgaacatttcctgtgtgcctttctcaagcgagaggatgtagcccagcgaactgtgtccccgactcatgtctttgagcgagcccacttctcgctggattgtgtcctactgcgcctcatgaggcgtccgtggagccatccatcgcttgtcttaatccgtcctgctgctgctgccgcttccggcgctcagcgtcgccacaccgtttggaccctgaggctcgctcagattgatgagctcctctctggctcagacactcgctggaggaatgaatagccaggctctgacctcaagcaaggcatgaactcagnctttattaagaaaattcacattttccaggggcagcagaccgggatcgatgcgtggcgcttgtctcctgttgcccacaccgtcttcgaaatctctgttactgctcccagatgcccttctagtattcactgctctctctcgattcttgatttt

SEQ ID NO: 217 - DNA, 1435 bp, Homo sapien
gcttttttttttttttttttttttttttaaataagaaaaacccggtaatgattttcggggttgtagaggaaataggagagaaaatggggggaaataggtgtattaaactataagggtttttccctcggtgtaaatagagggtttaatgttgtaaatggtggtgtggggtgaaggtgtgccccattgtggtggtgggtggttaaatactgttaaagggtactactagggctggtaactagctagtggtggagttccgtgttaagataggagggctgatatgtgtgactcagggaaaacggtggttcactacccacagaagagtttcttcccagtatagggttaactagcgggcggggcttacagcgcgacgcagttcaacgcgaagcctctgtgcctaacaaagcttcctccacaaacgtctctatcacagcgcgggacgctcacagtttgtgaaaagtccctctgaacaaaaaggctatcacctgacatgccccacctgggtcacgtgcccgtccgatacttttctgaacatatgtgcccaagcgcccaacaatccttcacttcccggcatgtgtaaacgcaccagtggggcgcgcaagtacactcgacaaaacatgacgtgagcccccggacaaaaccgtggggcggtcaacccacactgggcccaacaagcgtggtatccctggtggtgcgaccattgcggtcactcccggcgtcccacaactgtcccaccacaacaccaaccgtcaagccacaccacaccacaccaaccacaaacacacaccccacatcaccaccacccacaccccaccaccaacacaacacttaacacaacgataccctaacccaccctcactcaacactacacaactacaacaaccccctacctacaacaccgaactctaatcttcaacctacactcacacatcacaataacataaatatataccctcttctccacacaccctaccctccactactctcacttccacatctccaatcacaactacctctcaactccctcctactatacacatcacacacatattaacataccccccatccccaccccccactactcatcactacacaccctaaccaccctaccaaacaactccaccaataacccaaaccgataatcccactaacaccatccactcagtagacactaccaatcccaatctacaacatccacattcccacacactccactcccccactactaactttacaacacaccaccacccatacacatcttctacaccaccctcatacccacatacaacaacataaaaactcaaccacaccacaataacccaacacaaaaaccaccccaccctacaccactaacaccacatcacacaccccccacactcaacacacaaacacaaccacacaacaaaacacgacctcccccaccacccctcacacaccc

SEQ ID NO: 218 - DNA, 534 bp, Homo sapien; identical to SEQ ID NO: 12

SEQ ID NO: 219 - DNA, 173 bp, Homo sapien
catcagcaggcgcgggcgccaccgcgggcccacgcggcacccgtgggcgacacggtaccccggtcacactccacaaattgccgcacaaccggcgaccagagaagaagccgccagcaagcgccagaccgccagcacgacgtaaccaacgacctaccacacacagacgcaaccag

SEQ ID NO: 220 - DNA, 515 bp, Homo sapien
tgcgtatgctcggcgttatttccactagagactactacagcgcaatactgacgcatacaaaacactcttagagcataacaacagacacacgtagactacacaacccagaaaaagaacaataataaaaagaataaacactacatagtaaacacccacatagagaaagcacaaccaacacagaacacgcaacatcccacacgaaaaccagacaacaccacgaaccacagacacacagcgccacacacagaagaccgcagaccgaacacaacacgacccatacaagaacaaagaaccacgcgacaggcaccaaacaaacgacatcacaccagccaagacaccagaaacaaagcacataaacaacggaaacgaaagatcacgcacacgacaaccaccacacaccacaccacgacagcacagcaaacgagacaccccacccacacaaacgcgacaacacgacccaaaacgcacaaccacaaaccaaccacacagaacaacaacacaaccaaaacaacaca

SEQ ID NO: 221 - DNA, 261 bp, Homo sapien; identical to SEQ ID NO: 182

SEQ ID NO: 222 - DNA, 284 bp, Homo sapien; identical to SEQ ID NO: 144
  misc_feature (162)..(162): n=a, c, g or t
  misc_feature (172)..(172): n=a, c, g or t
  misc_feature (230)..(230): n=a, c, g or t

SEQ ID NO: 223 - DNA, 424 bp, Homo sapien; identical to SEQ ID NO: 152

SEQ ID NO: 224 - DNA, 314 bp, Homo sapien; identical to SEQ ID NO: 21
  misc_feature (307)..(307): n=a, c, g or t

SEQ ID NO: 225 - DNA, 2528 bp, Homo sapien; identical to SEQ ID NO: 22

SEQ ID NO: 226 - DNA, 2734 bp, Homo sapien; identical to SEQ ID NO: 72

SEQ ID NO: 227 - DNA, 193 bp, Homo sapien
gatccaaccacttggggctgtggtgcaacgaacaccccgcatacaacccgacgaaggcgctttaacacggtacaccaacagcactcgaactccaaaccaggcacacacgacttaacgaccactggcaacgacactgcacacaggactaccacacgcagcatttacgcgggacacaccccgcagccaggggcca

SEQ ID NO: 228 - DNA, 1457 bp, Homo sapien; identical to SEQ ID NO: 13
  misc_feature (1024)..(1024): n=a, c, g or t
  misc_feature (1073)..(1073): n=a, c, g or t

SEQ ID NO: 229 - DNA, 1527 bp, Homo sapien; identical to SEQ ID NO: 14
  misc_feature (457)..(457): n=a, c, g or t

SEQ ID NO: 230 - DNA, 697 bp, Homo sapien
aactccgaccaacccgcgggcctaaaccgccgcgctccgccgctatacggagccgctcgtcacccgcgcatacctcagcccaactagacctccgcctgccacgtctcccccccaccggtcctcgcgccgacgcgcgctactcacactccgcctccacatgagcctccactacgccctatcccgccccccctcccgggcgtctaccgcgccccgcgcggccaccccctcgtgcgccgggctcaggggcgcggcgtcgcacggcgcgcgcgcgccgcgctccgccccggctcgcggtcgcccgctccgttcacgccccctcaggcgtccgcgccccccctcgaccgcgcgactgcgccgcactcttcccgccccgacgccgccacgcgctggccgcgccctcccgcgcgcggcgcgccatagccgcctaccgccggccctatcccgccctgccacgcgtccgcctctctcgcgccccccctggtcccgcccctcccgccttgcggcatccctgtgccccttccctcccctcgccgcctgcggtctgcggccccgcgccgtcaccccgcggcctctccacgctgtcgcccctcgccacgccccccctcggactgtcccgcgccccggcccccccgcgcccctccctcccgccccccccctctctccccgcgccctgccccctcccctctgcctccccccc

SEQ ID NO: 231 - DNA, 342 bp, Homo sapien
catgcagatgatcctacactcacagttgaacttggcgtggccgctcacctgcccgacatttccacgtcgtggaaaacgctgtcgctgccagcttgcacttaactgaatctccggccagactgcggccagtgggaccagggcagcgcattgcgtaataagggcggctcttccagccgctccactcggcctcacctgagctacggcctcgcagcacgcgggacccgtacagcggtgggacgcgacgcgtggactcacgcctcagctcaaacgtgccagggaaccacgggtcaacaccaccaagacagccacggagactaacgggagagaagaaaaccatagcga

SEQ ID NO: 232 - DNA, 250 bp, Homo sapien; identical to SEQ ID NO: 6

SEQ ID NO: 233 - DNA, 438 bp, Homo sapien; identical to SEQ ID NO: 108

SEQ ID NO: 234 - DNA, 1536 bp, Homo sapien; identical to SEQ ID NO: 84

SEQ ID NO: 235 - DNA, 351 bp, Homo sapien; identical to SEQ ID NO: 83
  misc_feature (274)..(274): n=a, c, g or t

SEQ ID NO: 236 - DNA, 1523 bp, Homo sapien
tttttttttttttttttttggtttttttttttttttttttttttttttggggggtggccccctttttttttaccaagtctttcccttttcccaccaagaaaacaaacccccgtgatttctccgagcccccatattaaacaacatgggtgacccactatctgtccctccctgtgggagtaatctcctcttttttaacaacacacacacaaaccatcccgcgagaaaatatttgtcgcgcccacataaatatttccgctgggcccactcatatttctcacagaacaatctcccatattatctatcacactgtggaaacatattatgtatgtgccgctctacaacatctgcgcgacaacagcgggaagaggagaacctcctcttgtgggccccactctcccagagactccaacctataccccgcggaagggagcggggagacactctccggcccccacaagagagaatatactctctccacggcgcccccacacacacacaacaacaacaaaacacccccccacgcccacctctctctccacagggacaaaaccgggcccacaggcggcgtctttctcggagcgccacaaatattatattccccggagtggtcccccccgaggcttgtggccgccacaaatcctcccctatccccgcgcggcctctgacaaccctggcgcccgtggggcgcaacgcgtggccccccgccccatatcttctcgcgctcgccccccccacacatatcactctcttttcggacaaaacacacctctcccacacgaggaccgcgcagggaaatctatctctctctcaccgcccaaaacaagaattccccccaaccaaccagcgcggcggctctcccacagaaatattttcgtgcccaacaccgtgcgggggcaaaacccccacggcgcccaaccgcggtccccccgcggcgcgccacacgtggcgatcccgccgcccccacatttccccccacatactctgccaccaccacaccccccccccccccaccccacccaccccacccaccacatccacccccccaccaccacccacccccaccaccacccccaccaccaacacacccaccaacccccaccacacccaacccaccacacccaccacccccaccccacctcccccacccccaccccctcaacccaccccacccccacaccccctgccaccccgaccctcaccccccccacccctccccactccgcaccacccacccctcacgccccctccccctccttccaaccgtcacccacccccaccccctcccatccacccccactccacctctccactcaccacccactccccactacccactacactcctcctcgcctacctcctcacttcctctcacccttacctcactcctccacttctcatcctcacacgctactctatctacacttccctctccctcccccccctcatcgcacacacccaccacccacatccctctacagtctctcctacaccccccccctcatcacacccaccacacaccccca

SEQ ID NO: 237 - DNA, 194 bp, Homo sapien; identical to SEQ ID NO: 167
  misc_feature (92)..(92): n=a, c, g or t
  misc_feature (99)..(99): n=a, c, g or t
  misc_feature (160)..(160): n=a, c, g or t
  misc_feature (168)..(168): n=a, c, g or t
  misc_feature (179)..(179): n=a, c, g or t

SEQ ID NO: 238 - DNA, 121 bp, Homo sapien
agggcccaagtccccactacacttctcactctcctacaaattattctctcatccaccacaatatacaccctacgaacccacccatacccacgacttgccaacaaagcacacacaatttttc

SEQ ID NO: 239 - DNA, 1807 bp, Homo sapien; identical to SEQ ID NO: 9

SEQ ID NO: 240 - DNA, 376 bp, Homo sapien; identical to SEQ ID NO: 46

SEQ ID NO: 241 - DNA, 739 bp, Homo sapien; identical to SEQ ID NO: 154

SEQ ID NO: 242 - DNA, 695 bp, Homo sapien; identical to SEQ ID NO: 138

SEQ ID NO: 243 - DNA, 733 bp, Homo sapien; identical to SEQ ID NO: 139

SEQ ID NO: 244 - DNA, 684 bp, Homo sapien
agggaaagagggagaacaagaagagatgagagaaaaggggaaagtaaaaaagacgagagaggaagaaaaagaaagaaaagaaagagataagcgagacaacgcaagtcagtgcccaagagtgacgacgtgaacagcagacccagaccaaacagcccaacgccgagcagaggcaggaaacgcgctcacagagagccgccggatcacgaccacaccaacgacagccaacgtgcaccaccgcggaggcccctcaggagcagcacacggccgaccaccgcgcagcacagcaggacaagacgccaccaacatcaaacaggccggcgacatagcgagagaacctgaacacccacaacggccagcgcgcgaatcacgcgaccgcgccagagcacacacggcctgagggccacgccgccggccaagacagagcagggagccacggccacacgccagcgaaagacgagaagaaacgcaaggaggagcagcgccaagtagcagcccgagcgcgcacaggaagaagcaagagcgaaacgaagcagaagcccacccaccgcaggacaacaaagcaagacagacagcaacagacaaatacgggaggagggaaaaacagagaggagggaaagacaagcaagacaggcgacacgcgaacagacaccaccaaaccggagagcgagccggcagagcacgaga

SEQ ID NO: 245 - DNA, 154 bp, Homo sapien
agacacaccgcaagacaaagacagacgcggccgcaccaactaacagagaacaccacacacaagacaaccagccaggaaaccagccgccccaacaggacccccacacaccaacacccacacaagacgccagaccaccacgacaccaaaccaacca

SEQ ID NO: 246 - DNA, 152 bp, Homo sapien
gttagagccgatatcactggaagatattcaaaccgtctctatgcttacgaacctgcagatacagctctgttgcttgacaacatgaagaaagctctcaagttgctgaagactgaattgtaaatgtctgtcaggccttgagacttgaaaccaga

SEQ ID NO: 247 - DNA, 968 bp, Homo sapien
ttttttttttttttttttttttggttttttttttttttttttaaaaaaaaaaaaataggcctcgtttatatttttctcttgtgttcaagctgtggcatttttgaaaacccgtgcgtgtgtttgccaaccctttcccccaagaggagaattatccgtggggtggacccaagtctcttcagggtgtgtaaaagggccctgtggcccacacacagcaggactctccagagccctccctcattatgtggccaggaatctcaagcctggggagttacctcagtgggccaataagccgtgttccgcgtggtgataataattgtgttatctccgcttcatcaatttcccaaccaacattcgcaaacacaatggctcgcggactcacaaaatctcacaacaacagacaattacggagacaccaactcacaaaacacataacaccaagcaccgctgcaaccgacaacgaaaagccggaaatcccaagaccaccaaccgatccaacacagcaccacacaaccaaccacagccacacaacacgcaaccccacccaccacccacaaccaccaccaaaccagcacacaacacaccaacacccaactaatcacaaaacaaacaaaaaacatcacaacgcaaaacacaacaatacaacgcaaccaacaccaaccccgacacccacaacaacaccacaaccccacgcccagcacagcctagacaacaacaacaaaaacacaaaacaaacacactcacacagacacacccacgccacagacgcacgccgccgccacccacccccccccacgcgaccccgcccgccccgacgcacacacgccccagccacgcacacgaccgaacccccaccacgcaacccacacagcacagcacaaacacgccccacccagcgccacacacgcaacagaccagcaccccacacaccaacaccacacacgccctcacgcgaccgccacgccgcaccc

SEQ ID NO: 248 - DNA, 291 bp, Homo sapien
gatacctgtcccgacctctcatccccttcccggcgaacgaccgtggccgcatttactcatacgctccaccagctggtagcgctactcttccaacgctctccgcgtagtaatagagtgaaggtcacaagattatcacaagagcattggggcatccgctggtcgcacccgacaaccagcacacccccggatttcatggcacctagtaccaggctatgcccacactaaacatacccgagtaaatgtccattccagtcatttcgaacatcctaaaccccgcgcaccacaagaacg

SEQ ID NO: 249 - protein, 28 aa, Homo sapien [sequence omitted]

SEQ ID NO: 250 - protein, 108 aa, Homo sapien
MRRWVWSQKRYRQTQILNGFAFLSMTCSQAPQSPHGLPSIWPLQPTLPKAFCPRSPGGSPALQASHSPMAGGCCWSAVKWKGGPRGGLGSAPGTRAVALILTNLRRCP

SEQ ID NO: 251 - protein, 108 aa, Homo sapien; identical to SEQ ID NO: 250

SEQ ID NO: 252 - protein, 71 aa, Homo sapien
CKSVVAPATDGGLNLTSTFLRKNQCETRTMLLLPAGSLGSYSYRSPHWGSTYSVSVVETDYDQYALLYSQG

SEQ ID NO: 253 - protein, 120 aa, Homo sapien
KKAALSMCKSVVAPATDGGLNLTSTFLRKNQCETRTMLLQPAGSLGSYSYRSPHWGSTYSVSVVETDYDQYALLYATLYSRTQTPRAELKEKFTAFCKAQGFTEDTIVFLPQTDKCMTEQ

SEQ ID NO: 254 - protein, 235 aa, Homo sapien
AGKTTLLNYILTEQHSKRVAVILNESGEGSALEKSLAVGQGGELYEEWLELRNGCLCCSVKENGLRAIENLMQKKGKFDDILLETTGLADPGIITIVDSKYWIKSEIPLKAEENEIIPPTDPFPIAYGGPKQQRIGQRNDSSLFGLDTRATDIVLFSSTNVDSICNRSNESYPEKHLTEEKPDGLINEATRQVALADIILINKTDLVPEEDVKKLRTTLRSINGLGQILETQRSR

SEQ ID NO: 255 - protein, 953 aa, Homo sapien [sequence omitted]

SEQ ID NO: 256 - protein, 728 aa, Homo sapien [sequence omitted]

SEQ ID NO: 257 - protein, 151 aa, Homo sapien [sequence omitted]

SEQ ID NO: 258 - protein, 72 aa, Homo sapien [sequence omitted]

SEQ ID NO: 259 - protein, 119 aa, Homo sapien
NGRSVLESAFERRPGRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 260 - protein, 127 aa, Homo sapien [sequence omitted]

SEQ ID NO: 261 - protein, 130 aa, Homo sapien
SVLKPGKRGEKALQRAEREADHRREKGKILAPTVARVLSFCPHECDSARNLEWLKTVNESHGSVERSSLTLATAINQRGIYVIQAPKGGQKISPDTVLHLILPESPGSHEESREYSLEKVSRVSKQNPLL

SEQ ID NO: 262 - protein, 160 aa, Homo sapien
MTNTKGKRRCTQYMSSRPFRKYGVVPLATWYMRIYETGDTVDIKGMGTVQKGMSHKCYHGKTGRVYGITQRAVGIVVNKQVTGQILAKRIVPIEHIKHTKSQDSFLKCVKENDQKKKEAKEKGTWVQIKRQPAPPREAYFVRTSGKEPELLEPIPYEFMA

SEQ ID NO: 263 - protein, 194 aa, Homo sapien
WREFTGNRLQQLRLLPTGSYTVCFSGCSRLALNLNPGTFLSGFLLLLNIFLHTFQEALLALSVLNVLNRHNSLGKNLACNLFVYNNANSTLGNTVDSSSFAMVTFVGHSFLNSTHSLDVYSITCLIDSHVPCGQRNNSIFSKRPRGHILGASPLSLCICHFGKLLEDGCSSQKVLSLLKCFFLYLECLVSRISF

SEQ ID NO: 264 - protein, 71 aa, Homo sapien
MARYEEVSVSGFEEFHRAVEQHNCWKDPNNDFRKNLKVTAVPTLLKYGTPQKLVESECLQANLVEMLFSED

SEQ ID NO: 265 - protein, 243 aa, Homo sapien
QTLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHRQSRLYKRKANDESNEHSDVIDSQELSKVSREFHSHEFHSHEDMLVVDPKSKEEDKHLKFRISHELDSASSEVN

SEQ ID NO: 266 - protein, 62 aa, Homo sapien [sequence omitted]

SEQ ID NO: 267 - protein, 305 aa, Homo sapien [sequence omitted]

SEQ ID NO: 268 - protein, 262 aa, Homo sapien [sequence omitted]

SEQ ID NO: 269 - protein, 450 aa, Homo sapien [sequence omitted]

SEQ ID NO: 270 - protein, 447 aa, Homo sapien [sequence omitted]

SEQ ID NO: 271 - protein, 135 aa, Homo sapien
MAAGPMAAEPCGPHALVALAGLVTGIPTHHPRVYNIHSRTVTRYPANSIVVVGGCPVCRVGVLEDCFTFLGIFLAIILFRIGPAAIGQWQPPNGSRTQTPRAELKEKFTAFCKAQGFTEDTIVFLPQTDKCMTEQ

SEQ ID NO: 272 - protein, 150 aa, Homo sapien
ALLEAWARDRGVSVQVRTSLPQPLHEEPPPWGTWRPGAHSVPGPSSSQDVGLQPGGGHRVEGAHGGYRGTNHTGLRHSLLGVDSLLLAEVEKDPLFVSSAQGEVGGDGGSVQFGGSVKTSSALREEQEAQWENWPKSGVLTTAPGFFLGR

SEQ ID NO: 273 - protein, 227 aa, Homo sapien
RRHSSRSSCSGPPRPGHLPRSPTPLAPGPGHPLCCRRMATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPHWGSTYSVSVVETDYDQYALLYSQGSKGPGEDFRMATLYSRTQTPRAELKEKFTAFCKAQGFTEDTIVFLPQTDKCMTEH

SEQ ID NO: 274 - protein, 122 aa, Homo sapien
RRSVMDWSRPRYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPQK

SEQ ID NO: 275 - protein, 63 aa, Homo sapien
VIDVIHEVAHSWFGNAVTNATWEEMWLSEGLATYAQRRITTETYGAAFTCLETAFRLDALHRQ

SEQ ID NO: 276 - protein, 116 aa, Homo sapien
MLWVWFHITAIKLQREEEEAFASSQSSQGAQSLIFSKFEGKKTNKKTRKVTTVKKSSVRLPGSDQRRILKWIPGVCLETSWPASPSAASTSSMPSRSPRTSWRQQMTSSPPSSTLF

SEQ ID NO: 277 - protein, 57 aa, Homo sapien
MDRVSKEFIEFLKTFCKTGQEIYKLTKLFLEGMHYKTLCFYVIILNLPFCNASLPKG

SEQ ID NO: 278 - protein, 144 aa, Homo sapien [sequence omitted]

SEQ ID NO: 279 - protein, 105 aa, Homo sapien
FFLQNAVGQPARGLETRLLRAQSSGWAAALCAASRSSGSGVSAEQGEGRRSRILNTSSLKRGKEGGGKNPLYWKTNNPRKLTWSEPIFKVRKYNGDFATLLYGKD

SEQ ID NO: 280 - protein, 295 aa, Homo sapien
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREIFYIIGAVVFVVIILVIILAISLHKCRKAGVGQSWKENSPLNVS

SEQ ID NO: 281 - protein, 67 aa, Homo sapien
METPAWPRVPRPETAVARTLLLGWVFAQVAGASGLGRGNPKGLDCCLDWSRYNVVHAPYFYEVFGTA

SEQ ID NO: 282 - protein, 76 aa, Homo sapien [sequence omitted]

SEQ ID NO: 283 - protein, 129 aa, Homo sapien
MSSPINSDVRLFGSRSFLSHETVKKYPAPLAAVLIKVDPRVLPCGSKKRQLAHLLTPSRQRRQQQAGPPPSHANHPRECSWAPPAPPRQCSWGVCGEDAIQGAVRSSSSSPSCWTRSAWSFCCWGSWPP

SEQ ID NO: 284 - protein, 129 aa, Homo sapien; identical to SEQ ID NO: 283

SEQ ID NO: 285 - protein, 52 aa, Homo sapien
MQIMPHIILFFCCTVICSTFEIQKYITISQGAAGFPGARGLPGPPGSNVSNC

SEQ ID NO: 286 - protein, 347 aa, Homo sapien
MVNLVVKEKEGLRVRKVKEALLELQDPLEVLDLLVLLVPKVSKVNVAVLVDLVLLASLVLVVFLVLLVVMVTQDPQVPAVLQARMGPQVLRVTLVLLAALECLDQKVMLANQERRDRLVPRAHQELQAHLGLLGSLEHGVLQDHQACQVLGEALALRVSRVKVGNQELTVSVENVVPLDPRVFLVWLVQLVNLEEMETLDQMVFQAEMDLLVARVIVVKMALLVPLALLVIQAHLVLSVQLERVVTEEKVALLALLVLPVLLVPEVLLVLKAHVVTKVKQVNVELLASKDIEDSLVIQVPQVLQALLVSRVQSAVQDLQAPEDPVGPMWTPGKDGPVGSRPWTTGLE

SEQ ID NO: 287 - protein, 327 aa, Homo sapien
MQIMPHIILFVCCTVICSTFEIQKYITISQGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPMWTPGKDGPVGSRPWTTGLE

SEQ ID NO: 288 - protein, 702 aa, Homo sapien
QGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPWSSQRWFRLQLPAPATSREGSRGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYINKNPKDKRHVWFGESMTDGIPFQFGGQGFDPSDVAIQLT

SEQ ID NO: 289 - protein, 82 aa, Homo sapien [sequence omitted]

SEQ ID NO: 290 - protein, 360 aa, Homo sapien
MAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRVGREGRSEGGEGPDPGRAAQRRGQSSPLHKPCSPWARSTTWARAQAIQCCRWSRLWRRPLGRRSRTRWWHGGKVMWQPVTPTPAWPKRSWGGQQP

SEQ ID NO: 291 - protein, 466 aa, Homo sapien
MAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRVGREGRSEGGEGPDPGRAAQRRGQSSPLHKPCSPWARSTTWARAQAIQCCRWSRLWRRPLGRRSGPPTPPTSPTSPHPALSNRAALALPTHLSGGYLALPSLLSLPSTRCLRASRCSALLLLKDLASSWARAGSAKLQLPPVLQIPYKVVARREGDVAACYANPSLAQEELGWTAALGLDRMCEDLWRWQKQNPSGFGTQA

SEQ ID NO: 292 - protein, 328 aa, Homo sapien
MAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNAVLLRYFNPTGAHASGCIGEDPQGIPNNLMPYVSQVAIGRREALNVFGNDYDTEDGTGVRDYIHVVDLAKGHIAALRKLKEQCGCRVGREGRSEGGEGPDPGRAAQRRGQSSPLHKPCSPWARSTTWARAQAIQCCRWSRLWRRPLGRR

SEQ ID NO: 293 - protein, 77 aa, Homo sapien [sequence omitted]

SEQ ID NO: 294 - protein, 280 aa, Homo sapien
MDLQGRGVPSIDRLRVLLMLFHTMAQIMAEQEVENLSGLSTNPEKDIFVVRENGTTCLMAEFAAKFIVPYDVWASNYVDLITEQADIALTRGAEVKGRCGHSQSELQVFWVDRAYALKMLFVKESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 295 - protein, 173 aa, Homo sapien
MDLQGRGVPSIDRLRVLLMLFHTMAQIMAEQEVENLSGLSTNPEKDIFVVRENGTTCLMAEFAAKFIVPYDVWASNYVDLITEQADIALTRGAEVKGRCGHSQSELQVFWVDRAYALKMLFVKVTPSPAGRGAAGSAWVWEVAAPRFKNPDAAGTIEAHLPGSTGKPQHVQGT

SEQ ID NO: 296 - protein, 90 aa, Homo sapien
MDLQGRGVPSIDRLRVLLMLFHTMAQIMAEQEVENLSGLSTNPEKDIFVVRENGTTLWPQPVGAASVLGGSRICTQNALCKGKPQHVQGT

SEQ ID NO: 297 - protein, 280 aa, Homo sapien; identical to SEQ ID NO: 294

SEQ ID NO: 298 - protein, 321 aa, Homo sapien
MDLQGRGVPSIDRLRVLLMLFHTMAQIMAEQEVENLSGLSTNPEKDIFVVRENGTTCLMAEFAAKFIVPYDVWASNYVDLITEQADIALTRGAEVKGRCGHSQSELQVFWVDRAYALKMLFVKVTPSPAGRGAAGSAWVWEVAAPRFKNPELRGRLKRTSPAQQESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 299 - protein, 373 aa, Homo sapien
RTVTVRTRIAVLSLRPQCGGILFRHVVVLTLGNGLGQNLDLASVQAHAAVQGRRVLIPGVNIRQENLGRGRFHDHVQDAAVGGVGQALRCHQHKAVGLTQHLEPFPDLRAECRVAEHQPGFVQDDERPPVWWNSNPEKDIFVVRENGTTCLMAEFAAKFIVPYDVWASNYVDLITEQADIALTRGAEVKGRCGHSQSELQVFWVDRAYALKMLFVKESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 300 - protein, 363 aa, Homo sapien
MKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNMLWSVPTLTSCRMSPSPLTESPIPSAQLPTPYWTSWMECSSAAVAFKDLTSTLQLGPSGSWGMSSFDSFTQSLTVGITVWDWPQQSPKEGPCVCACLSDRP

SEQ ID NO: 301 - protein, 282 aa, Homo sapien
MGCWGRNRGRLLCMLALTFMFMVLEVVVSRVTSSLAMLSDSFHMLSDVLALVVALVAERFARRTHATQKNTFGWIRAEVMGALVNAIFLTGLCFAILLEAIERFIEPHEMQQPLVVLGVGVAGLLVNVLGLCLFHHHSGFSQDSGHGHSHGGHGHGHGLPKGPRVKSTRPGSSDINVAPGEQGPDQEETNTLVANTSNSNGLKLDPAGEPGKSLPQVVGFGVPRASPGLRRGGPHAPCCPSGPAPRRPCLLPPRPAHAPLLLQEIRTPSVGCKEPATRLAYL

SEQ ID NO: 302 - protein, 177 aa, Homo sapien
ATALKDVVKVGAVDADKHHSLGGQYGVQGFPTIKIFGSNKNRPEDYQGGRTGEAIVDAALSALRQLVKDRLGGRSKDVLDSEDVWMVEFYAPWCGHCKNLEPEWAAAASEVKEQTKGRVKLAAVDATVNQVLASRYGIRGFPTIKIFQKGESPVDYDGGRTRSDIVSRALDWFSDNA

SEQ ID NO: 303 - protein, 82 aa, Homo sapien
MLTQSQQVLRGILVFLQNILQEPSPAMCFPKKRSLWPNLRKQWASIHINDPRGTLCPRCTGCNQRGSGGSGLIWRDSFYHHP

SEQ ID NO: 304 - protein, 152 aa, Homo sapien [sequence omitted]

SEQ ID NO: 305 - protein, 42 aa, Homo sapien [sequence omitted]

SEQ ID NO: 306 - protein, 197 aa, Homo sapien
MVDLTQVMDDEVFMAFASYATIILSKMMLMSTATAFYRLTRKVFANPEDCVAFGKGENAKKYLRTDDRVERVRSHCKAVTISIFERQSQNGATNEVKSMLYRVQQLKLIHTHMEQLTKDLRAHLNDLENIIPFLGIGLLYSLSGPDPSTAILHFRLFVGTRIYHTIAYLTTPLRQQIRASVFVGYGVTLSMAYRLLK

SEQ ID NO: 307 - protein, 146 aa, Homo sapien
GRCLRPARAATVPALRATRRRDRLAASSSSASPFQTKIEKMVDLTQVMDDEVFMAFASYATIILSKMMLMSTATAFYRLTRKVFANPEDCVAFGKGENAKKYLRTDDRVERVRSHCKAVTISIFERQSQNGATNEVKSMLYRVQQL

SEQ ID NO: 308 - protein, 187 aa, Homo sapien
GRCLRPARAATVPALRATRRRDRLAASSSSASPFQTKIEKMVDLTQVMDDEVFMAFASYATIILSKMMLMSTATAFYRLTRKVFANPEDCVAFGKGENAKKYLRTDDRVERVRRAQEILGPERQIQKNLHVNETGVEMRMAGNAWKQTCNCLMAWSSKSQRMECNGMISAHRNLCLPDSSDSPASAS

SEQ ID NO: 309 - protein, 115 aa, Homo sapien
YSCVVFHGVYVPHCLYPIHIDGHLGCISPFLILCESLKPLPRFLQIPLWHIISRLTLDLGSCLYACFHILQLVMLDVNPALSSVPFKNELKKMWLKIDLSKWKCRGVYTVAAQTF

SEQ ID NO: 310 - protein, 149 aa, Homo sapien
GRCLRPARAATVPALRATRRRDRLAASSSSASPFQTKIEKMVDLTQVMDDEVFMAFASYATIILSKMMLMSTATAFYRLTRKVFANPEDCVAFGKGENAKKYLRTDDRVERVRSLEWSRPLYSHPALQTICRSTDLPHHCIFDTPSPAK

SEQ ID NO: 311 - protein, 86 aa, Homo sapien
GRCLRPARAATVPALRATRRRDRLAASSSSASPFQTKIEKMVDLTQVMDDEVFMAFASYATIILSKMMLMSTATAFYRLTRKSPPE

SEQ ID NO: 312 - protein, 114 aa, Homo sapien
GRCLRPARAATVPALRATRRRDRLAASSSSASPAHLNDLENIIPFLGIGLLYSLSGPDPSTAILHFRLFVGARIYHTIAYLTPLPQPNRALSFFVGYGVTLSMAYRLLKSKLYL

SEQ ID NO: 313 - protein, 145 aa, Homo sapien
AVPASGPRGHSPCIARDPAAGQACCFLLLGLTVFANPEDCVAFGKGENAKKYLRTDDRVERVRRAHLNDLENIIPFLGIGLLYSLSGPDPSTAILHFRLFVGARIYHTIAYLTPLPQPNRALSFFVGYGVTLSMAYRLLKSKLYL

SEQ ID NO: 314 - protein, 530 aa, Homo sapien
PSDHRTGLGRDVGAGARRAARCRAEAAAAVGTARSPALGMALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGEECPGGKLCGQQSWFTLLSLCISAPGVKSFPSDLSPGAPVGLLRGSSLKTLHLPYHKFKCCMAFDTLDSQDTFQ

SEQ ID NO: 315 - protein, 376 aa, Homo sapien
MADYWKSQPKKFCDYCKCWIADNRPSVEFHERGKNHKENVAKRISEIKQKSLDKAKEEEKASKEFAAMEAAALKAYQEDLKRLGLESEILEPSITPVTSTIPPTSTSNQQKEKKDKKKRQKDPSKGRWVEGITSEGYHYYYDLISGASQWEKPEGFQGDLKKTAVKTVWVEGLSEDGFTYYYNTETGESRWEKPDDFIPHTSDLPSSKVNENSLGTLDESKSSDSHSDSDGEQEAEEGGVSTETEKPKIKFQEKNKNSDGGSDPETQKEKSIQKQNSLGSNEEKSKTLKKSNPYGEWQEIKQEVESHEEVDLELPSTENEYVSTSEADGGGEPKVVFKEKTVTSLGVMADGVAPVFKKRRTENGKSRNLRQRGDDQ

SEQ ID NO: 316 - protein, 619 aa, Homo sapien [sequence omitted]

SEQ ID NO: 317 - protein, 164 aa, Homo sapien
RSLATRSAGPAVSPLFFFNSARGPRPTGPGCSAGQSACGVVGKVESGDVSGNSCLRSGRRRRAELLGLEPASLEGGWRFWAPGEDTETAGWRRDLRLEIPSFSSGPVALLPLPGDLNPFIPTPPLWSREYRPCRGRGEEAISNADWIVWAPVVGNSGTLVPGTE

SEQ ID NO: 318 - protein, 361 aa, Homo sapien
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQSLSAVCWGRRQQRWKVFQTWQRPSISGVSRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSVDTFLVSWA

SEQ ID NO: 319 - protein, 122 aa, Homo sapien
MGGFKYGDEQPRSDWRSYRRNLEHAVLELTLFKTVPSKMEIHSSPFKCSTAPPCNTSGQGKITEHSCEPDFCCLWIDKKQNSFSSGVGNRSLDSLLIKGSSPFLVLGVRGSFGKMHPSIVAF

SEQ ID NO: 320 - protein, 78 aa, Homo sapien [sequence omitted]

SEQ ID NO: 321 - protein, 92 aa, Homo sapien
VPLIIFTIKANSEACRDGLRAVMECRNVTHLLQQELTEAQKGFQDVEAQAATCNHTVMALMASLDAEKAQDSSSAAAPQLLIVLLGLSALLQ

SEQ ID NO: 322 - protein, 178 aa, Homo sapien
MASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEGEITTLNHKLQDASAEVERLRRENQVLSVRIADKKYYPSSQDSSSAAAPQQHNQQLGRRSC

SEQ ID NO: 323 - protein, 188 aa, Homo sapien
MASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEVTTLNHKLQDASRPGFLFSVAPPLQTRLRRENQVLSVRIADKKYYPSSQDSSSAAAPQLLIVLLGLSALLQ

SEQ ID NO: 324 - protein, 108 aa, Homo sapien
LRSLEREAAGEGTGRRGEGPWGRRENPVRRMPWIGGGLIAVWGGAINGGGSIDGGEGLMDGWGGSSDGGGAWGRAWSGASACCLQSALSPSSGPLGTSWKVRPARLFA

SEQ ID NO: 325 - protein, 250 aa, Homo sapien [sequence omitted]

SEQ ID NO: 326 - protein, 68 aa, Homo sapien
  MISC_FEATURE (1)..(1): x=any amino acid
XLDREQPLGSRTQYPRPRDTSFSGLSLEEYKLILSTDTLEELKEIDKGMWKKLQEKFAPKGPEEDHKA

SEQ ID NO: 327 - protein, 221 aa, Homo sapien
MMGSDSGPRPSPSQCLLNSTACAESTHQDSNPCSTSQLCNLSKLLHCLLPQFPHLKTGDRKGCVEQAKFCDEASGSVGCTADSAGPFLCPHTEQGNEQHIPALMPRVRRGQETTDSVLGTESGTQCSVPASGHFCYLFDLLFRSWVSTFFRNTLCEKQAMLVSGKPSGSNLCHQVLDFSPSLFLSSPFADTLEELKEIDKGMWKKLQEKFAPKGPEEDHKA

SEQ ID NO: 328 - protein, 108 aa, Homo sapien [sequence omitted]

SEQ ID NO: 329 - protein, 172 aa, Homo sapien
GKALCHPQIAMAQVPPGTPRRGLPRHQGLGHATHLHQAVFCWVAEGMRADTTCSPRVAVGTAAEGLLLRVHMWGKEMLQAPRGRARAALRRLAVATRTMAGVSELESALQMEPAAFQALYSAEKPKLEDEHLVFFCQMGKRGLQATQLARSLGYTGARNYAGAYREWLEKES

SEQ ID NO: 330 - protein, 335 aa, Homo sapien
MGTKAQVERKLLCLFILAILLCSLALGSVTVHSSEPEVRIPENNPVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKSAPRGSPLYCPHPRAWHGCHLSTDPDTVLMCVGVVPWGTLITHLTPRAGGLPLHLPKPCCLLSC

SEQ ID NO: 331 - protein, 351 aa, Homo sapien
MGTKAQVERKLLCLFILAILLCSLALGSVTVHSSEPEVRIPENNRELGGAMEGVRVSSCRPPGDLESTQPSLQFGAVPHLVYLLLFFLRLILTLSAAVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKGTSSKKVIYSQPSARSEGEFKQTSSFLV

SEQ ID NO: 332 - protein, 250 aa, Homo sapien [sequence omitted]

SEQ ID NO: 333 - protein, 66 aa, Homo sapien
PVSELESALQMEPAAFQALYSAEKPKLEDEHLVFFCQMGKRGLQATQLARSLGYTGYGEVWLLAGR

SEQ ID NO: 334 - protein, 113 aa, Homo sapien
GDSEDPRFDPDGPGSSTCALARRRQLGPSQGRSTSRCPSWRVLCRWSQLPSRLYILLRSQSWKMSISFSSVRWASGASRPRSWPGVLDTLGLATTLEPIENGWRKRVRQEAAY

SEQ ID NO: 335 - protein, 220 aa, Homo sapien [sequence omitted]

SEQ ID NO: 336 - protein, 199 aa, Homo sapien
GKALCHPQIAMAQVPPGTPRRGLPRHQGLGHATHLHQAVFCWVAEGMRADTTCSPRVAVGTAAEGLLLRVHMWGKEMLQAPRGRARAALRRLAVATRTMAGAGRARLFDVRSREEAAAGTIPGALNIPVSELESALQMEPAAFQALYSAEKPKLEDEHLVFFCQMGKRGLQATQLARSLGYTGARNYAGAYREWLEKES

SEQ ID NO: 337 - protein, 105 aa, Homo sapien
MLQAPRGPGRARLFDVRSREEAAAGTIPGALNIPVSELESALQMEPAAFQALYSAEKPKLEDEHLVFFCQMGKRGLQATQLARSLGYTGARNYAGAYREWLEKES

SEQ ID NO: 338 - protein, 131 aa, Homo sapien
MAAVTPRPPLPEGCRAPSSAPTVSLPELRSLLASGRARLFDVRSREEAAAGTIPGALNIPVSELESALQMEPAAFQALYSAEKPKLEDEHLVFFCQMGKRGLQATQLARSLGYTGARNYAGAYREWLEKES

SEQ ID NO: 339 - protein, 134 aa, Homo sapien
MEGGVREREGAAAHPVLPTPQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNE

SEQ ID NO: 340 - protein, 76 aa, Homo sapien
QFIGTASLIVCVLAIVDPYNNPVPRGLEAFTVGLVVLVIGTSMGFNSGYAVNPARDFGPRLFTALAGWGSAVFTTG

SEQ ID NO: 341 - protein, 367 aa, Homo sapien
PPALEAAARCATASRHPCPPDSAAACPAMGRQKELVSRCGEMLHIRYRLLRQALAECLGTLILVMFGCGSVAQVVLSRGTHGGFLTINLAFGFAVTLGILIAGQVSGAHLNPAVTFAMCFLAREPWIKLPIYTLAQTLGAFLGAGIVFGLYYGKHSPPCPPPLPPSLCSGPAGTRPFDDRRLDLPRPRAHDSLIHAQGQDAIWHFADNQLFVSGPNGTAGIFATYPSGHLDMINGFFDQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 342 - protein, 214 aa, Homo sapien
ATPSACCNTAVLLLTHNSWEGGEGTPEREVWAQASPPTHCVSNLSPDAIWHFADNQLFVSGPNGTAGIFATYPSGHLDMINGFFDQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 343 - protein, 105 aa, Homo sapien
MAKISSPTETERCIESLIAVFQKYAGKDGYNYTLSKTEFLSFMNTELAAFTKNQKDPGVLDRMMKKLDTNSDGQLDFSEFLNLIGGLAMACHDSFLKAVPSQKRT

SEQ ID NO: 344 - protein, 222 aa, Homo sapien
GLEFERWLNATGPPLAEPDLSQGSSLTRPVEALFQLWTAEPLDHAAASASAIDISKWRTFQTALFLDRLLDGSPLPQEVVMSLSKCYSSLLDSMNAEIRIRWLQIVVRNDYYPDLHRVRRFLESQMSRMYTIPLYEDLCTGALKSFALEVFYQTQGRLHPNLRRAIQQILSQGLGSSTEPASEPSTELGKAEADTDSDAQALLLGDEAPSSAISLRDVNVSA

SEQ ID NO: 345 - protein, 450 aa, Homo sapien
ELTAGAGLIPAGWKVGCGCAGWESEPRGLPPSPPSRCRYDIVFLPPSFPIVAMENPCLTFIISSILESDEFLVIDVIHEVAHSWFGNAVTNATWEEMWLSEGLATYAQRRITTETYGAAFTCLETAFRLDALHRQMKLLGEDSPVSKLQVKLEPGVNPSHLMNLFTYEKGYCFVYYLSQLCGDPQRFDDFLRAYVEKYKFTSVVAQDLLDSFLSFFPELKEQSVDCRAGLEFERWLNATGPPLAEPDLSQGSSLTRPVEALFQLWTAEPLDQAAASASAIDISKWRTFQTALFLDRLLDGSPLPQEVVMSLSKCYSSLLDSMNAEIRIRWLQIVVRNDYYPDLHRVRRFLESQMSRMYTIPLYEDLCTGALKSFALEVFYQTQGRLHPNLRRAIQQILSQGLGSSTEPASEPSTELGKAEADTDSDAQALLLGDEAPSSAISLRDVNVSA

SEQ ID NO: 346 - protein, 366 aa, Homo sapien
GSEQQSQWCVSPQSSPRPCRCTPRASVHIWTCEGQWRLALAAPRSLTTAPPYSTGHWWFRTPAQVGVHLAGVNPSHLMNLFTYEKGYCFVYYLSQLCGDPQRFDDFLRAYVEKYKFTSVVAQDLLDSFLSFFPELKEQSVDCRAGLEFERWLNATGPPLAEPDLSQGSSLTRPVEALFQLWTAEPLDQAAASASAIDISKWRTFQTALFLDRLLDGSPLPQEVVMSLSKCYSSLLDSMNAEIRIRWLQIVVRNDYYPDLHRVRRFLESQMSRMYTIPLYEDLCTGALKSFALEVFYQTQGRLHPNLRRAIQQILSQGLGSSTEPASEPSTELGKAEADTDSDAQALLLGDEAPSSAISLRDVNVSA

SEQ ID NO: 347 - protein, 756 aa, Homo sapien
VAGVPPAAAETPCAFAFSAPGPGPAPPPPLPAFPEAPGSEPACCPLAFRVDPFTDYGSSLTVTLPPELQAHQPFQVILRYTSTDAPAIWWLDPELTYGCAKPFVFTQGHSVCNRSFFPCFDTPAVKCTYSAVVKAPSGVQVLMSATRSAYMEEEGVFHFHMEHPVPAYLVALVAGDLKPADIGPRSRVWAEPCLLPTATSKLSGAVEQWLSAAERLYGPYMWGRYDIVFLPPSFPIVAMENPCLTFIISSILESDEFLVIDVIHEVAHSWFGNAVTNATWEEMWLSEGLATYAQRRITTETYGAAFTCLETAFRLDALHRQMKLLGEDSPVSKLQVKLEPGVNPSHLMNLFTYEKGYCFVYYLSQLCGDPQRFDDFLRVSSPLPGTALLPSAPSPSPAHRAACSCGSWGGTGRGLGAWLGPSLPFFVGSAWVATSPSATLFAPLAGPACQVLAPQCPLAAPVPSTYLGARPAVPCRPLVGLPVPHPSRPAEAPPPATQAYVEKYKFTSVVAQDLLDSFLSFFPELKEQSVDCRAGLEFERWLNATGPPLAEPDLSQGSSLTRPVEALFQLWTAEPLDQAAASASAIDISKWRTFQTALFLDRLLDGSPLPQEVVMSLSKCYSSLLDSMNAEIRIRWLQIVVRNDYYPDLHRVRRFLESQMSRMYTIPLYEDLCTGALKSFALEVFYQTQGRLHPNLRRAIQQILSQGLGSSTEPASEPSTELGKAEADTDSDAQALLLGDEAPSSAISLRDVNVSA

SEQ ID NO: 348 - protein, 38 aa, Homo sapien
MSKNFIFTNLIDQKDTLLAFFTICKAKNHQNSPSPHIY

SEQ ID NO: 349 - protein, 231 aa, Homo sapien
MLERRSVMDRRPGREFDGILGLGYPSLAVGGVTPVFDNMMAQNLVDLPMFSVYMSSNPEGGAGSELIFGGYDHSHFSGSLNWVPVTKQAYWQIALDNIQVGGTVMFCSEGCQAIVDTGTSLITGPSDKIKQLQNAIGAAPVDGEYAVECANLNVMPDVTFTINGVPYTLSPTAYTLLDFVDGMQFCSSGFQGLDIHPPAGPLWILGDVFIRQFYSVFDRGNNRVGLAPAVP

SEQ ID NO: 350 - protein, 47 aa, Homo sapien
MSVNMYYRRSYSLSFCFRFYVLLPFSNKSMKGKRISTRNIHFFPSQI

SEQ ID NO: 351 - protein, 361 aa, Homo sapien
TGISLASQLKVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCERLSDCPPGTEAELKDEVGKGNNHCVPCKAGHFQNTSSPSALCQPHTRCENQGLVEAAPGTAQSDTTCKNPLEPLPPEMSGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCG

SEQ ID NO: 352 - protein, 399 aa, Homo sapien
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 353 - protein, 435 aa, Homo sapien
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 354 - protein, 450 aa, Homo sapien
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSKGFVVLIPKLQRPFGVPHFTWTEVDPA

SEQ ID NO: 355 - protein, 635 aa, Homo sapien [sequence omitted]

SEQ ID NO: 356 - protein, 194 aa, Homo sapien
KKREGGREKKGSGALIIVWVSISFLQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 357 - protein, 305 aa, Homo sapien
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQVMAGAEKAARRGRGDEGTRWSRQEESMQADSTLIHSFN

SEQ ID NO: 358 - protein, 1127 aa, Homo sapien
MWSLTASEGESTTAHFFLGAGDEGLGTRGIGMRPEESDSELLEDEEDEVPPEPQIIVGICAMTKKSKSKPMTQILERLCRFDYLTVVILGEDVILNEPVENWPSCHCLISFHSKGFPLDKAVAYSKLRNPFLINDLAMQYYIQDRREVYRILQEEGIDLPRYAVLNRDPARPEECNLIEGEDQVEVNGAVFPKPFVEKPVSAEDHNVYIYYPSSAGGGSQRLFRKIGSRSSVYSPESSVRKTGSYIYEEFMPTDGTDVKVYTVGPDYAHAEARKSPALDGKVERDSEGKEIRYPVMLTAMEKLVARKVCVAFKQTVCGFDLLRANGHSFVCDVNGFSFVKNSMKYYDDCAKILGNTIMRELAPQFQIPWSIPTEAEDIPIVPTTSGTMMELRCVIAIIRHGDRTPKQKMKMEVKHPRFFALFEKHGGYKTGKLKLKRPEQLQEVLDITRLLLAELEKEPGGEIEEKTGKLEQLKSVLEMYGHFSGINRKVQLTYYPHGVKASNEGQDPQRETLAPSLLLVLKWGGELTPAGRVQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDELLESTNTKLWPLKLTLEVAAWFILLIFILEILLKWLSNFSVFWKSAWNVFDFVVTMLVRIEILRVRLVG

SEQ ID NO: 359 - protein, 55 aa, Homo sapien
RVTVLFSSFFFSLQQTVCGFDLLRANGHSFVCDVNGFSFVKNSMKYYDDCAKILG

SEQ ID NO: 360 - protein, 72 aa, Homo sapien [sequence omitted]

SEQ ID NO: 361 - protein, 91 aa, Homo sapien
FLPDACGLSDVAHVESLQEKSQCALEEYVRSQYPNQPTRFGKLLLRLPSLRTVSSSVIEQLFFVRLVGKTPIETLIRDMLLSGSSFNWPYM

SEQ ID NO: 362 - protein, 273 aa, Homo sapien
MGRSRSRSSSRSKHTKSSKHNKKRSRSRSRSRDKERVRKRSKSRESKRNRRRESRSRSRSTNTAVSRRERDRERASSPPDRIDIFGRTVSKRSSLDEKQKREEEEKKAEFERQRKIRQQEIEEKLIEEETARRVEELVAKRVEEELEKRKDEIEREVLRRVEEAKRIMEKQLLEELERQRQAELAAQKAREVTLGRLESRDSPWQNFQCWVLPPAQFRKRWNTDYLIPFSSKLNIAAKVNFLAYSEVLTDNLKVGSFYKTYSRILFDLMELAI

SEQ ID NO: 363 - protein, 142 aa, Homo sapien
MKLNEKFSEGWRKPNASWKSSCSKNSSDRDKLSLPHKKLERGSWRVWQPRSTLCRTLDKTEEERAKREELERILEENNRKIAEAQAKLAEEQLRIVEEQRKIHEERMKLEQERQRQQKEEQKIILGKGKSRPKLSFSLKTQD

SEQ ID NO: 364 - protein, 102 aa, Homo sapien
MSLKSATKWGRRCNYYYQHLESIMNLLEYFLALTSFILRCSYWIFPSANNMEVPIQGQIIPGFIWSCLKVKSLEFLMIPFLYGLQFDRWEFSTLKKVINGKM

SEQ ID NO: 365 - protein, 92 aa, Homo sapien
LSSQLHGCISVGTQASPGYLSCSCRLPPGLRRGAPDPGIVRLRPAKEGPAGGAPAGVSCLAAGRGDLEDRVKLQKTWGGMAREDAKDWGRGS

SEQ ID NO: 366 - protein, 160 aa, Homo sapien
MSLKSATKWGRRCNYYYQHLESIMNLLEYFLALTSFILRCSYWIFPSANNMEVPIQGQIIPGFIWSCLKVKSLEFLMIPFLYGLQFDRWEFSTLKKTLLLSGNPCPPLTSTQNCFPHSLTARVVKNWDVLLRWAVECHTESRSLGVSLCCPGWSTEVAVN

SEQ ID NO: 367 - protein, 119 aa, Homo sapien
SSKVSRDTLYEAVREVLHGNQRQRRKFLETVELQISLKNYDPQKDKRFSGTVRLKSTPRPKFSVCVLGDQQHCDEAKAVDIPHMDIEALKKLNKNKKLVKKLAKKYDAFLASESLIKQI

SEQ ID NO: 368 - protein, 59 aa, Homo sapien
MSSKVSRDTLYEAVREVLHGNQRKAARKFLETVELQISLKNYDPQKDKRFSGTVRLAPF

SEQ ID NO: 369 - protein, 110 aa, Homo sapien [sequence omitted]

SEQ ID NO: 370 - protein, 61 aa, Homo sapien
KGPTGAPRVRPYYTVLSSDHEQQSLSRHPVRGGAGSPAREPAQGCSQVPGDGGVADQLEEL

SEQ ID NO: 371 - protein, 402 aa, Homo sapien
MLSPQRALLCNLNHIHLQHVSLGLHLSRRPELQEGPLSTPPPPGDTGGKESRGPCSGTLVDANSNSPAVPCRCCQEHGPGLENRQDPSQEEEGAASPSDPGCSSSLSSCSDLSPDESPVSVYLRDLPGDEDAHPQPSIIPLEQGSPLASAGPGTCSPDSFCCSPDSCSGASSSPDPGLDSNCNALTTCQDVPSPGLEEEDERAEQDLPTSELLEADDGKIDAGKTEPSWKINPIWKIDTEKTKAEWKTTENNNTGWKNNGNVNSSWKSEPEKFDSGWKTNTRITDSGSKTDAGKIDGGWRSDVSEEPVPHRTITSFHELAQKRKRGPGLPLVPQAKKDRSDWLIVFSPDTELPPSGSPGGSSAPPREVTTFKELRSRSRAPAPPVPPRDPPVGWALVPPRPP

SEQ ID NO: 372 - protein, 243 aa, Homo sapien
MMPLSRWLRSVGVFLLPAPYWAPRERWLGSLRRPSLVHGYPVLAWHSARCWCQAWTEEPRALCSSLRMNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLNLIELFLQVYCRQGPMPRGCPW

SEQ ID NO: 373 - protein, 380 aa, Homo sapien
MYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECRNKTDLSRRSLLDAGSIKGESILLFPVAEEKEKYHEEG

SEQ ID NO: 374 - protein, 679 aa, Homo sapien
MYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSFLLKTGQFLAVWQEETAGVHFTGSWARCRQFPGALQVLQKYRAKSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 375 - protein, 124 aa, Homo sapien
MVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPGRHGISHHNLIG

SEQ ID NO: 376 - protein, 95 aa, Homo sapien
KKKKKKNKKQKIHHNKRPNVNKDEGRRGVAVAERRQRRSTEGLGLQALQETPRRSLVSQPALSGRPEREALASERLLGAWGSALWRSSMASQQSL

SEQ ID NO: 377 - protein, 68 aa, Homo sapien
MSPRCSSHAAARLYDRAPHDAQIRRGCSLEGESVCRGHPRPHGCWGLTGRVRASGRGRAGRDSPALTP

SEQ ID NO: 378 - protein, 190 aa, Homo sapien
SVANMQLFVRAQELHTFEVTGQETVAQIKAHVASLEGIAPEDQVVLLAGAPLEDEATLGQCGVEALTTLEVAGRMLGGKVHGSLARAGKVRGQTPKVSESISGHGVRTFFPFTAKPSPWALTRFAFSLPGDEPEGRDARCGRQEPGPDPSLLQVAKKKKTGRAKRRMQYNRRFVNVVPTFGKKKGPNANS

SEQ ID NO: 379 - protein, 69 aa, Homo sapien
FKLLTMYGEGKVHGSLARAGKVRGQTPKVAKQEKKKKKTGRAKRRMQYNRRFVNVVPTFGKKKGPNANS

SEQ ID NO: 380 - protein, 295 aa, Homo sapien; identical to SEQ ID NO: 280

SEQ ID NO: 381 - protein, 376 aa, Homo sapien; identical to SEQ ID NO: 315

SEQ ID NO: 382 - protein, 619 aa, Homo sapien [sequence omitted]

SEQ ID NO: 383 - protein, 63 aa, Homo sapien; identical to SEQ ID NO: 275

SEQ ID NO: 384 - protein, 190 aa, Homo sapien; identical to SEQ ID NO: 378

SEQ ID NO: 385 - protein, 305 aa, Homo sapien [sequence omitted]

SEQ ID NO: 386 - protein, 25 aa, Homo sapien
MTNTKGKRRCTQYMSSRPFRKYGVV

SEQ ID NO: 387 - protein, 361 aa, Homo sapien; identical to SEQ ID NO: 351

SEQ ID NO: 388 - protein, 105 aa, Homo sapien; identical to SEQ ID NO: 343

SEQ ID NO: 389 - protein, 71 aa, Homo sapien; identical to SEQ ID NO: 264

SEQ ID NO: 390 - protein, 243 aa, Homo sapien; identical to SEQ ID NO: 265

SEQ ID NO: 391 - protein, 363 aa, Homo sapien; identical to SEQ ID NO: 300

SEQ ID NO: 392 - protein, 151 aa, Homo sapien [sequence omitted]

SEQ ID NO: 393 - protein, 71 aa, Homo sapien; identical to SEQ ID NO: 252

SEQ ID NO: 394 - protein, 197 aa, Homo sapien; identical to SEQ ID NO: 306

SEQ ID NO: 395 - protein, 42 aa, Homo sapien [sequence omitted]

SEQ ID NO: 396 - protein, 38 aa, Homo sapien; identical to SEQ ID NO: 348

We claim:

1. An isolated monoclonal antibody, or antigen-binding portion thereof, which competes for binding to the epitope bound by an antibody which specifically binds an antigenic region of SEQ ID NO: 265 wherein the antigenic region to which the antibody specifically binds is selected from the group consisting of:
   (a) amino acid residues 59-65 of SEQ ID NO: 265;
   (b) amino acid residues 71-83 of SEQ ID NO: 265;
   (c) amino acid residues 130-141 of SEQ ID NO: 265;
   (d) amino acid residues 169-177 of SEQ ID NO: 265;
   (e) amino acid residues 186-193 of SEQ ID NO: 265;
   (f) amino acid residues 195-202 of SEQ ID NO: 265; and
   (g) amino acid residues 226-240 of SEQ ID NO: 265.

2. The antibody, or antigen-binding portion thereof, of claim 1 wherein the antibody, or antigen-binding portion thereof, is a humanized antibody.

3. The antibody, or antigen-binding portion thereof, of claim 1 wherein the antibody, or antigen-binding portion thereof, is a chimeric antibody.

4. The antibody, or antigen-binding portion thereof, of claim 1 wherein the antibody, or antigen-binding portion thereof, is labeled.

5. The antibody, or antigen-binding portion thereof, of claim 1 wherein the antibody, or antigen-binding portion thereof, is conjugated to a toxin.

6. An isolated monoclonal antibody, or antigen-binding portion thereof, which specifically binds an antigenic region of SEQ ID NO: 265 wherein the antigenic region to which the antibody specifically binds is selected from the group consisting of:
   (a) amino acid residues 59-65 of SEQ ID NO: 265;
   (b) amino acid residues 71-83 of SEQ ID NO: 265;
   (c) amino acid residues 130-141 of SEQ ID NO: 265;
   (d) amino acid residues 169-177 of SEQ ID NO: 265;
   (e) amino acid residues 186-193 of SEQ ID NO: 265;
   (f) amino acid residues 195-202 of SEQ ID NO: 265; and
   (g) amino acid residues 226-240 of SEQ ID NO: 265.

7. The antibody, or antigen-binding portion thereof, of claim 6 wherein the antibody, or antigen-binding portion thereof, is a humanized antibody.

8. The antibody, or antigen-binding portion thereof, of claim 6 wherein the antibody, or antigen-binding portion thereof, is a chimeric antibody.

9. The antibody, or antigen-binding portion thereof, of claim 6 wherein the antibody, or antigen-binding portion thereof, is labeled.

10. The antibody, or antigen-binding portion thereof, of claim 6 wherein the antibody, or antigen-binding portion thereof, is conjugated to a toxin.

11. The antibody, or antigen-binding portion thereof, of claim 1 wherein the antibody, or antigen-binding portion thereof, is a human antibody.

12. The antibody, or antigen-binding portion thereof, of claim 6 wherein the antibody, or antigen-binding portion thereof, is a human antibody.

* * * * *

UNITED STATES PATENT AND TRADEMARK OFFICE
CERTIFICATE OF CORRECTION

| | | |
|---|---|---|
| PATENT NO. | : 7,678,889 B2 | Page 1 of 1 |
| APPLICATION NO. | : 10/523834 | |
| DATED | : March 16, 2010 | |
| INVENTOR(S) | : Roberto A. Macina et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 499 days.

Signed and Sealed this
Fifteenth Day of March, 2011

David J. Kappos
*Director of the United States Patent and Trademark Office*